United States Patent 8,216,786 (GENETIC POLYMORPHISMS ASSOCIATED WITH CARDIOVASCULAR DISEASES, METHODS OF DETECTION AND USES THEREOF) - sequence listing, part 8

SEQ ID NO: 1235 - DNA, 977399 bp, Homo sapiens
ttctctcacaggtagtttctgttgcctgcttttatttttctcttgtatgagtcacactttcctgtttctttgcgtgtctcataatttgttgttgaaaacttaattttagataatatattgttacaactctggagggcccccttctgcctcacatgtttattgtagtttgcatgtttagttgtatagtcacttgctgggctgttagaatagggtctatttccctcacagtatgaagactctgattttgctcctcagagggtgcaggctgacatgtgcacagtcagcctccaatacagtgcttttagaagggctgtcttccaggctctttttccatgatcatacccagctgttaagctctactaattcccaactgattgatctattgtttatacaatgccctggagcataaattgctccctagactgaaaacaattcaattaaacttgggttcctttatggggtaattttgagatgaatgtctgaggtttgcttggacccaaagaaggctcttcttagctctcttttttttctctcataagcttactggtttgtggtttaacttaaatccctcatgaaggtaccatcctcttcctaattgctttctaccaaaacctcctttgattttgagatccttaaaattgaacttctctacactccgttgaaagtcaagtcagtttttttgtttatttttttgttttcttatggcctatctcttcccctggaccaaatctctgagccatggctttggaattagttgtggggacagtcatatgcttctctctgatgacaacctagatttagaaggaatcttggtgggggcagcagcctctggtattctaggcgtacctcttgacacagaaccttctccttacaaattagctatgtttagggcaattggctagaaagaatctccctgttctatgaatgagggctgagtgaaagaaggtagccttgacctcctggccacactctcctgatatttagcctctgcaacaggtaattgtggggaggacaggaaatgctaaaggcatgtccttcccagaaagatgccacattccctttactgggttctggggttgcctggggagtgaagggtactactatgttattggctgtgctcacctggagtggagtttctgccgtgctgagctggcagggagaaggttgtggaacaaatgccacagactctcaccgttcttgatgagttttactagattttcttgaataaatatttcttcattgatatatatgtccttaaaaccacttccagagtttttaaatgtgtgtgtgtttaaataattttcacctccacttagcttgttttccttgggagtgggtccactggactccttacattttgattccatatgtcagaacccaagaatatactttaaatatatgacaccaaagatagaaatgtaaagaaaaactactaaattgattatataaaaatgtaaaaaatctttctctctctctctctttctttcttcttttctcttgagatggagtctcgctctgttgtccaggctggagtgcaatggcatgatctcggctcactgcaacctccacctcccgggttcaagagattctcctgtctcagcttcctgagtagctgggattacaggtgcctaccaccgcacccagctaatttttgtatatttagtagagaagggggtttcgccatgttggccaggctggtttcaaactcctgacctcaggtgatccacctgcctcagcctcccaaagtgctgggagtacagatttctaaagttaaaaggcaaatagaaagaaatattttcaacggataaaagtttactaccttaaatattctgaaatctttgactaatctctaggataaagatgaaaactcaaataaatgaataaggaacacagaggcaattcataaaatgcatataacacataaacataaaaaaatctttaacctcactagaattttttaaaaaaggaaaacaagaaacactttatgtccacaaattagaaaatatataaataaacttacaatactcagcaaagaactgaaaaaatacactatgatgagagagtaaattgacacaaactttggcgaaatgaataaatatcatattaaaaacatatataacctttccatgttgcatttaatttatttaaagacggtatatatagtgtgatgtatggctgatggctgtgtgcgtgcatgtgttttcgtgtgtattgtttttaacctgtaagggtactgctgttaacatttgcagagccctaatcaggaatacatattgcagagggcaggtagcatctgtaaacgtcttatctgaaactctcttgagattcaattaacagcatttactatcaacaatacaagccttgctaattggcacaattgaacatagcaatgattattatcactggtgaatgattattttctctggtgaaaagattggtgtttaagatatgggtctggctagaaatactgcacagtgagttttgcccttgcatagcacagaaggaaaatctggtgagccgaataacttataatcttaggaatgatgttttgtgattttgattccgatcagttctgtgttgagcagttttcagaggatttttttgcctgactccaagtaagactttaattgaatcctgcccttgcaatattgtcgcatttgcctctggtgaatctttgattcaaaaggctattggagaaactgtaaggacagaggagttgggactttattgagcttacagtttgaatagctgctttttaatgtctgctatgttgttatgtgtgcagaatttagccttgaattatctcttcttacaatttactacattattttgagggtgatgaggatgaggcctagagccctcattacctctaattgttgatcatggatatctaccagaaagaatctaataattatgaatgaggaaagtcacaagactttttgatatggtttgactccctgtctgcacccataattctcatgtgttgcgggagctgcccagtgggagacaatcgaatcacggaggcaggtctttcccatgctgttcttgtgatagtgaatgtgtctcaccagatctgatggttttgaaaaccagagtttctctgcacaagctctctcctgtctttgctgccctccatgtaagatgtgacttgctcctccttgccttccgccatgcttgtgaggcttcccaagccacgtggaactgtgagtccaattaaacctctttcttttgtaaattacccagtctctggtatgtctttattagaagtgtgaaaatggactaataccctttctgacctagtagatcaagttctgggaatttattctgagttaataatttaaaatgtgtgtaaaatttaacatcagtgtatttatcaatgagttatttatcatagcagaacacaaacaacttgaatgctcaacaatagagaactgattatctgtagtatattctgaaatggaatattaagcagcttttaaaagtgaggggatatataactattgaatgatagagaaaagttcaggacacattgaatatgaagaaactgatattaaaaacatgaacaaaatgaaaatatttaagaaaatatgtaattacagttatgtgaatacaatgtaaattgtttaggataagatgaaaagataaatgatttgatgaattctgtataaattgaatgtctctaaattgaatcgcataccatatgggcggatgtggccgtttaaaggagacatttggtacagttgaccctcattattcacagataacatatttgtgaatttgcccacttactgaaatttacttataactccaaagtcaatacttaaggcacttgagtagacacttgtagacgcacagaggtatttgtagatgcacagagaataaaaattgtagttgcccaatgcacacattcccagcttagatcaaacaaagtgatgctctgtgttcttgtttcagctctcatattctaaaaaagtctcctttttgcagtatatttagtgcatgtttctcaaattttgggtttttctgttggtgattttgctgcttaaaatggcctcgagcacagtgctggagtgctgtctagcattcctaagcaaaagaaagctgtgatgtgcctcacagagaaaatacatgtgttagataagttttgttcaggcaagaattacagtgctgcaggccatgagttctatgttaatgaatcaacagtatatattaaagaaggtatctttatcagttgatgaaaatcttgttaccagaggctgtcaggaacataaccctttattgtctccagtgtttgcagtgactttatagaacataattactgaggacatcagaaatcaactataaatacttttgcaactaatagacctttggaacaattatttttggattttgtataaagaatccaaaaaaatctggaaaacgtgtggctaagaaaacagttgattggtccctaattccaccttattatgtttaaattcagtgggtgtctcacagccacgtttataaaggaatcttggctggggtgtcaggtttctagtttactttgactctatctgtcagtctgtgtccaaccttcatggcaattaactgtgcttttgtgtgctaattatcattatcccagtatgggcccattattagtccaatgtccttagtttaaagcttaagtgtcaatcagtcacctaaaacaattgcatagaaggaagctttgcaaggctggtttgaaagtccttagctgagttctactttattatactccagttcgaaactgaacacaaagctcttcttgatacaattgtttatttaaatactgatttatctacttaattaaagcaaacttgagtttatattttaaaatcagggatgggataattgctactttatgcttgaagatctattcaggtagctatacattaaacaagtaaaaccgtaattataaaacctgcacatttttatctgattgagtcgctcctgccattgaacgaccttattcaagtcatttagaacaaagaaaggtggcatatatgagttttttaaaatcccactggatgccaggagtaaggagaaaatagcatcaaatcagatgtggtcagaaaagaggtatttcttttcctgtgatgcttttcctctttcctcctcttacagtaaatccccacttatcaaatcttcagatgtgtagagaaggaataaggcaggggtaatgggggagtgggacagagagatgccctttctggagtttgcacaacggttgcatgctgagtaaaacctgatgatgtattccattcatgtctccaaaaagtcaaaagcggtttcagcgttgatttcccttaagagttatcagtcctcattcaattggtttaatgagtgtaagaggtgaccttgtgtctatgtagatactcccatattaaaagacctggatgtaaaacttcacatatgtgtaaatagttattttggagggtgttgtgagggttattgcagctctctgctcagctgctactcaggctaaacgggcaggagaaattttccactgtgttagaatgatgattatttgcaaattacatgagcaccagtaattcattcatgcaatgatacagagctgggtctcagtgcagtggtattgaacttgctgctgggggcgttaattgattcgtttggaacattcccctccagagaatcccaatcacaggtcccctgatcaagaaacggacacgcagtcggggtcctggatatgtagagacacacgtgtgaggctgttgtcatcaaaataaaccatttctgtcccctgacaggggttgagtctattaggaacactccccaatcctgggagcttccgcaagaggctttctatcttggcagaggtggcagctgagcatcgcttctttgctgcaggatggaaaaaagggactggattattggctgcattttaaactagctgctgttctagagaaaatgttggggagggactgaacaagcttagcactggatcagtgtgggggtgtgttggtgaaaagaaaaaatgcctcctcctaacttaacgtttaactgatatcccctcaacacgacccaaatctgtctctccagatacacaatgtctgttttcctaactacatggtgaactgtggagcaagtcttggtcatgtttagtttgtttcccagaatctactagaagacaatgcctagcatatagcaggcacagaataagggccaaaggggagaatggaaacaaaatatgtacatttgaaatttagaaacacagttaagggactttgcctgaaattgtcataaaactttgaaaattgcttcaatgtatagtcccagtgggagaatgtgacagcatattttattctttgttcttttctgaaattctgtgtccagtctaaaacacgacatttccctttaatgtgttaggagtatgcatgactacacaggaatattttctggagaacttctggtgaagcatattttgataaacagtcttactaaaagttatatatatgtacttttaattgactagttgcagagaaataatcaatgtaaaaaaaaatcatacatagtacaggtagtaaaagtcacagttccggcagaagcacaaaagccttcaaagtgagtgggaacctgggaaccattgatcctcagtggctgtttaccatggaaaacacctgcatcaccaacattccagttttgcaaaagtacctctattacagacacataccaggcaaggagggaggaaaaagcctgaaaatttctctccaagtttaagtaatcaggaaactttggtggggaggttggggtggggtgggggcgggggggtaacttctttatttagcattaatctcagcaatcatgaaagtcatggaatttcaagtgatgaaaaatttgaccacaacaatacctatcactagcctggttttgcccacttctcgaacaggaattataaagataataattaattctaaaaagcagaagacaaaacaaacaaaccaaaccaacactgaatgaactaataaggctgctgcatatatatgttggagttggatgtttatttgcttactgcagtagtttaaaaatagttttccagttaacatcttttccacatagtggagatgtcagggtaggtttacatgattgcgtaaatggtcagaagttgtttatgtagctctgaactgctgagagatgagcaggaagacctgggttcagcaaaacccttggggctttttcccagagagagaaacagaggctcctctctgggttgctggaatgctttccagacgaattcgactgggttggcttttctctgcctgtcaaagtcactttgcacagtgctggtgaggggctggggcattgctgccaatctctacggttaccccgaggtgtggagttgcggcgaagggagccacttctgcaaggaaacagtagattcataatgtagaatgaccgtggcaacgtcgttcaaagcacattctttcgaataacaaggctttcgacatgccccacccccgcgcacaacacaccacaaattgatccttgtacctaatttacagcaactgttccctctgacctccccccgcccccgccccacattccaacctgaaagcactttgcgtggatgagacttcaggtgtgtaacgcagcctgtccagccagtgtcctccgcctaaggacaggcaggtaaaaacctaccaaagccccctcttctggcctaagttcaatgccacccgcccacccacattccccggttcagcaattttcagcccagacgcagaagcatctgtttccctggccagggcgccttaacgatcccccgaattccgcgtctcccggaggccagaggtttgggtacccaggaaggtcgcgcctcctcgtgccccgatactcgggttgtaaagggaggagacatcgcctcggcgcatccctggccgctgaacaacgcaacccctacgtccccgcacgggaatccggctgataatctcctcttgcctgagaatcgggccaggcgccctttactaatttcgcgcgctggggacctggggctgccgcctctcggccgcgcggggcaggtgctgcgtccccagcgctcgcctcctccggccgcgcactgagcatgcgcgggctccgggcctccggcgcgtctccccgtccccgctcgtctcccgcccgttcccacccgcccgcgcctctccccttccccgagcgtctcccccgccccgcggctaaggagccggcagcccgaactccggcgcgccaggtttttccagccgccgcgagcgccgggagggagggcagcgccgcgccagacggagcccggggttcgacgccaggattggctgcaagtagggagctttcgccgccgccccgggcccctcggactgtgccggcgccgcacccgaggctctcgccagcccggcgccccggtgctgaggtaagtgaggcggcagctgtgcgggtccggctcctgcgtgggcgcgcgatgccccggggacgcggtcgcgggtgtgggggggaaagggcagggtccgcgcgggttgcccgaaggacaggggcgcttcccggggctctgactcccgcggggccgggcagcgtctgcggggccgtccagctcagagcccggaagccctgcagggtcggggagcgggagctgaacgcctgagcgcggaggactcagggccccgacgacgccaccgtcaccccacagcgacccttcttctccttctcagccggaaaataagtttgttgcgctgcgaggcagccacaaaacaaggaaccgagagcccggaatgctgcgggaagccttcaagtcagctcctccgactggttcgggctactgccccctctccgtgcgccctggcctctggcgccgggttcccggcggggcttttcttctgacagcccagtcacagcccgcagcagagggacgcgaacctggggagtggagggacctgggactaaaggaacaggagcccgtagccgtggtggaaggagccgcgtggagacggaggctgatgtctgtggcgcccgctgggtgccgggctggctgctgagcgctgaggctgcggcggcgagcgacaggccaggtgcctgctcttagggaaggtacctggcttccccagtctctgccgcgggagcctgttgggtggcattcgtttccagcaacttctggggggtttccagtttctttcgagaggcaagacaaccgccccgtcccctccccgggcccagacggcggcgaactgtgcgccgggcgccccacagaccccaatccactcactctccttctggaacgcggggctcaaaatcttcgtgcattttctctcttgtgcttcgtgtatatgttttactatttatgaagggtgtggaggtgagggtaggaggacgtgggctcctgaatccctctgaaccagccagagagtcggctgcatggaaacatttcgcagcgaagctcctgcgaggaggcggcttcgcgcgtcgggaagatcaggcggttgcttgctggccagggtctgcagattcggtgcgaagaagctggcggaggttgtgtagggcgagtcagtgtgactgagcaccctgggtgtgtggtctgcgtggaggagagtgggccggatcttgaggtgtgttggaggtttatttgtaagaggagttcctgaaaggaatgtcgtggaactttttctagttttcctgctggaatcaacataggggcgggcacatgtttgtcagaataacagtggcatttaactgcatgggaagctctttcaattttctgtagtgggagctggatagttcaaggagtaactccacataactgagtcgtttggatacccacacaagataatttggaacgcgcttgtatttttttgttttttgagatttctggtttatgtcctttagagagtggggtaggagcgtaaagactgtataggttgcctatgagcaggtccatacaatagcgttcccaagtctgcctaatagcaagtttgttctctctttctctctctctacccaagtgggtgaaaaagaacagtgtgtcatgaagacaggcacctggaggtgatttgggtggcattcatgagaaaattcacgttacccgtaagtttattcttgctatttttatcttgatttctttaaagattttgtgggaatatctgcagtgggtcgcaggagtaggtaagattgctaaggatcaaaaacaagtttcatgagaatattatttttgctaccttataaaatagctattgatttgtttgttgaagctggtttcaactgctctgtcttgttgaggagagatgatgctgataaacgtcattatttttccatctgaaccctgggaggtagctggcaaggatggaaaaactgaccttttcaattaaagactaagagtctaagagaagtgacttggataagggtgcatgtcagagccacatgtaagtttcaacagaggtagattttcctatttgcagttttttaaacaacacttttcagtttctttgagttgtaaaacttttcaagtcaattgggagtcaatgcagtacctttttccatggtcatttcatattggcaggtaattaagagtgattagagaacaaacctttcaaatgatgttggattttttatcattcacttattttacctacttctctctcctttttgttcaaaagtaggtcttctgatttcttttccgatctaagcactaaatcttttggctgcagtttttcttctgaaatgtatacagggcatccgttccttcaatttaggtcttaaaaaaataaagctgctcagcagaaaattcccatgcatggtactgacttttctacaagtttgtctgatcatgattttaacttgttgtttcttctttgttatatttgaggacagacataatatgcattagcttcaatctctcttatcttaaaaattaatattttgtaaaaacttgcttttatattattttagttgaataagtctatttcatatgataggcagggggaagtctctacacactgattttttttgttcctttttgttcatttttccctgtaatgctatgttttaagcctagtgaaggaggcaaggaggcaggatttactgcctagatttattgatcttcattattattattatttactatcagaagaaatctgacaacatatcaataaaatttatttataaactgaagacatgctgttatatgatacactacttataaaacacacaaagaaacaaaaaagatgaataaagcaaaaattatgaaatagaaggtctcatgttgctgttatgtatcccggtggatcattttgtacagcccctggggtgtgtagcacactttaaagatcactgctggtttgatatttttaaaatctttctctccttatctctgctctgctgttcatcatctctgatactctagccagttgtaaaactgctacacttctatatcttctgtaacaaatagattaagcacacttgttttcctctcatggactcatatgtggatagaatgaggtgtaaaggatgaatgtgttttggagatgtcatcttagatctcccaaagtagacatacaggtgaattttaaaaaatggagttttagtttaaagactaagtaccaatggtcaggaagtgaagaatccaaggagtaaatgagggaggattggaaggacactttccacattgcagtgttgtgtggaggctggaaagttcataaaccttgaagcagattaacctgaatctaagtctggcaccatcatttattacatttacagtcctgggcaatgtagttccttaatttctgtgagccttagtttctttaggtataaaattgggataacatctatttcacggcatcacgatagggattaaacatgagagcatgagtcaacatgggtcaagagcttggctcttttagattggctctttagcagatataacagatccaaaagggatactgcctcagatgtgaaatatatttatttctcggttgtgtgaagtcccagaatgggtgatcatggcagtactccttcaaagtgtgattcagagacccagccttcatctgttctgtgcccttgccgtcttcagcagggtcactgtgcttacttgcatcaagccattggaaagaggaagacttgggaggatgttaattgcccagaactggaatgagtgcatattacttttccttgcattgtgctggccagaacccagttctttgtggatgtacgttactattaaggaggctgggaaatatagtctagaaatgttatccaggaagtagaagaaattgttgggggaacaactagcattctctgatgttttattactatatgtgatatttcttccatgttcaataactgttacttccttttcttctcctaacccttgcttttttttttttctggtagaaaaactggaatggatacaataaataataatagaagcagttaatacatacataatgcttactattattgagatactttttaaagcacattgccctactttgcccttctaatattatctctattgtacagatgaggaaaactaggcatagagaaattaagttatttgttcatcatagctagtaagtagcagagctgggatctgaaccaggttctctcactccagaattgattttttaacagctttttttttttttgcttttgcctcaatacttttcttatttaagccactggaccgctttttacttttgcctatatataaaaaagttgccaagagaattttttaaaatactaaagtagaaaaaaaggatataatccaaaacatactggaatggaattagatatgatacagctttatcttgaatacctaccaggatcaggagcagatatttaaagtaactccccccacttacacacccttcaccactacaactgctctttcatttgtgataaacacattttcagggtctgtgccttgaattataaccttcctctgaagattctattgtgggagtcttgcgctaccactttcatgcttcagtatgtgaggataaattcctcttcacttctcagcagaaacaaatatcttccctggcaggtttttcagctaaaatagcctctcctaacttttgatcaaaggtattgctctttatcaatatccccatcctccaagaaaggaaaccctcttcttttcctatgagctttgcaaaattattttttatttatctatttatttatctttattttctatatgactaaggggactgtatatatatcccaggtaccgtctaaaagaaaatggtccctcttgttctcatcctgttgtcccatttccattagagaatctgcctcatcttatgtttcctatgtatttgtctttcataaaaatgcctgttagagttttggttcccagtggctgcagtggaaatgtgtagtggtcaatagtaagcgtatactttttgctaagatagttattgtttcaacattaaagagtgatttttttcctcttgttcagtatgtatttgttgcatcttcacaattaggtaatgatatgtatcttcttaccatgtaggtaggcataaatactgtatacctaccagtcatttctttcccagaagcccctgttcatttcctctttactttccctgagcctcacatcctgagaattttgcttttttttctgaactcctctttcttccaattttttccacttctgtgccatttatgtctacgtgtgtgtgtgtgtgtgtgtgtgtgtgcgtttcaagtcccttcttatgatttaatggggttggagggctggagaggttttcatgtgcttactgtcatgttttcagccaaattccacagggccttgtaacaggctaacatgagcagataagctcttaattttcagtgacttattttaactttttacttcttgctcatgtgtggtagttcagtactcatagaatagatcctgactgagtggctgtccatggggtcattcagggaatcaggttccttagagttttatggctttgttcatctttaagtacctagagtcctcatcattcagtcaagatacagagtgtgaggagataaataatccagagaagtcttattggaggttgttgtaggcacagcctggaagtggttgtcatgacttctgcccacattcctctggggtggacctcagtcacttcgacatcctttgctgcaagggaagctgagaagtggtgtctagctgagtgcctgggggagaagggtgaaaggaaaacaggtttggtaaataactagccagtctttgtcacaggtttccaatgaaagcatgtgagaaaatcagctaattctctaggtatggggaaaagagagcatggattttggttatttgccaaataaatgcccattgccttgcttccttttaattttgacctctattactatcccattcttagtgcatatggtctgggtgggattccgtttcccatttaaggattggagcatgggaaccaggtcttgtcgggaagagcattgacttttcctgtccacagtaattgcttctagaacagaacaggcatggacccagtgagaaccactgcagtgagatgctttgctttttctcagtggctctagttgggctccatgtatgcctttgaactaattcctgtagataaggagattagaaccagggagcatgtgggcctgccactgctgcagctgtcttaacaccaaaaagagaacctagacctgctgaggtcaccacatactacttgagaatgaagccaacagaacagtagcaaggggcatgatggagcaaaaccagctcctcttgcatcatgtgagcccgttaatctggctatgcctaaagtgagttaacctggtatattagtctattctcacactgctagaaagaactgcctgagactgggtaatttgtaaaggaaagaggttcaattcactcagttccgcatggcctcaggaaatttacaaccatggcagaaggcacgagagaagcaaaggcaggtcttacatggcggcaggcaagagacagtgaaggaggaagagccccttataaaaccatcagatctcatgagaactcacaatcatgagaccagcatgggggaaactgcttccacaatgcaatcacctcctaccaggtcccacccttgacacatgcaaattatggggattacctttcaattgatgagatttgcgtggagacacagagccaaaccatatcattctgcccctggcccctcccaaatatcatgtcttttcacatttcaacatgccttcccaacagtcgcccagaatcttaacccattttggcattagctcaaaagtccacagtccaaagtctcatctgagacaaggcaagtcccttctacctatgagcctgtaaaataaaaagcaagttagttaattccaagttgcagtgggagtacaggcactgggtcaatgttcctattccaaatgggagaaattggccaaaacaaaggggctacaggccccatgccagtctgaaaccaggcggggcagttattaaatcttaaagctccgaaatcatcttctttaactctatgtctcaagttcaggtcatgctgatgcaggaggtgggctcccactgtctggggcagttctgcccctctggctttgcaggctacagctcccctcccaactgctttcatggctggagttgagtgtctgctttcatggcacacagtgcaagctgtcagtggatctaccattctgaagtctagaggaccatagccctcttctcacagctccattaggcagtgtcccagtggtgactctgtgttgggagctccaacccccatttcccttccgcactgccctaacagaggttcttcatgagggctctgccccttcatcacacctcttgcctggacatccaggcatttccgtacatctactgaaatctaggcagaggttcccaaaccttcatttttgtcttctgcacacccacaggacgaacaccatgtggaagctgccaaggcttggggcttacaccttccgaagcaacagcttgagctataccttggccccttttagctacagctggagtggctgggacgcagggcaccaagtccctaggctgtacacagcagggagcccagtgccttgtccaagaaaccgtttttccctcctagacctctgggcctgtgatgggaggggctgccgccaagatctctgtcatgccctgaagacgttttccccattgtcctggctcctccttacttctgcaaatttctgcagctggcttgaatttctccccagaaaatgggtttttcttttctacagcatcatcaggctgcaaatttttcaaacctttttgctctgcttcccttttaaacataatttctaatttcagatcatcacactcaagtttaaagttccacagatctctagggcaggggcaaaattctgctagtctctttgctaaagcatagcaagagtgacctttgcttcagttctcgataagttcctcatctccatctgacctggacttcattgtccaaatcattattagcattttggccaaaaccattcaacaagtctctaggaagttccagagtttcccacatctttcttctgagtcctccaagtctctagtaagttccaaactttctgacatcttcctgttttcttctgagccctccaaactgttccagctctatctgttacccaattacaaagttgcttccacattttcgggtatctttatagcagtaccccactctctgcagtaccaatttactgcattagtctgttctcacattgttataaagaactacccaagactgggtgatttataaaggagagaggtttaatggactcacagttctgtatggcttgggaggcaacaggaaacttaaaatcatggtggaaggggagagagaagcaaaggtatatcttacatggcagcaagcaagagagagtgaatgagcaaaggaggaaaatccccttataaaacgatcagatctcgtgagaatcattcactatcacgaaaacagcatgagggaactgctcccatgatccagtcacctcccaatcaccacccttaacacttgggaattatggggattacaatttgagataagatttgggtggggacacagaaccaaaccatatcagctggtgattttgcagctcttcagattcataaattaccctttgacgtaagctgatttgggttggatttgtatgacttaaagtgaatactgatttattagaccaagcaaaaaagaggaaagaatactggataaggaagggagtgggggttttatttgtttgtttgttttcctgagctcatcttatgtcactttggttgtgtgcctaacagtttcactcccttgtaatacatcagacttccagtcaagaaccatttggcatacccctacccaggcacatagagctctcactaaattataaacccgaagctgttaattcttctcaaagctgatctctccttacagagttatggaagggaaatggaggtgaaatcacatcctcaggcttaattccctctttcaagattgcctgtggtccctcctggatgatgctttcttttccagcatcacttccctgttcctatcctcccccaggcttgcagaccaactgtaacaatctaatcacccatcctggaacttttcatgtgccttttcttttttttttttttttttcatgactgtttacattgcctctctctttggcctcctcttactgtccttgtctactgtgtttattacagtttgcacaatgctcaactcaagtatcactaagttaagcctctttcaatactattgaggcataaagaatggctccgtcacctgtacatactctcattgtacttgtttccatgccactgatataatatctgtcatgagaatgaccatctctcttgcttttcccaggacaggggggttcccaggatgctggatattcatttttaaaaccaggaaagtcttgatcaagccaggagaaatttgttgccttgccttctacattgtaatagctctcatttaacatgccactcggtgcaatggaatttcattgagacagtggataacagcttgaaatttggaggcaaaattcttaccaatcctagatccattttgtactagttgtgtgattgtgagcaagtgacctaacttttctaggttacagtttcatcatctgtgtagtggaatagtatgtgttttgtagggttgttagctaattaaaagacatcataaattaaatcacttcgtttagtgatggacacatctataacattgtctaaagcacacgagttttgtgaagattatgtagagtactacatgcaaagtacaagcaggacagtgcccaaatcctagtaagcatccagtacacagcttttgttatggattgttgttattcacttttaagtatctcttgcctaaaacatagtagatgccaaaaatacaattacactcagagaatacatgttcatggagcataaacaatgttactcagagtttgtgataagtggggcaagcaagtcagtgagagtgattaggaaatattttcgataattacttggtctttgaaacttgaaaaagctggaattgactgcaggattagttcctttttagaaacagtttgttttttcttgcatatttaaaccagacttcacaaattttcatagttcggaaagagaaaatattttccatgtttaggcaaggtcagtattggtgcataacccctaagtacatattttcattatttttattaatgaaataaaagtggcgcatttgggggaccaaaatgcaaatattttgtctttcttttggttcataagaaagtgaaggttagggcagtagaatcactactccattattaatcattattccataatgatcttgagttaaaaaaatcatatgatttgttgttgttgttgttaaccacagtgacatatcctctctacctttgggctgaacttttgtatataaaaatactttgtaacttgcacacttgtattaatataaatcttgagtgtccatgttgcctatgcctttcagttttgtcatggaaatttccagtgaggacaggtgttgcatgtgtgcttatgctgagatgggtccagtctggacaagaagacaatcaaacaaaacaatgatatgactcaaatcaccaagtatgttttgtaagatttgattctaggcacattgtcatcattttaagttgtgcaaatttgtattgttatccatattatgatgggtcttcaactattaattataaatacgaatttttttgtctttagtcactcatttgattagctattagctagatattgattctagactccttacagattagtgaattaattgggagtccaagcattatttttagtgtatttaattgggtgaatgacagctttatagagaaagtgattacttaagttgcatatctaattcttagtaaaaaattatagtacaaacaaggtcatctagaattcttggatctaagtaatggtaaattaagagttgcttttaatataatagtatcttttaaaaatggatatccctgtaaaatgtcttcattttctgcttaagcaggtgactaaagataatttacttcttgatgacacgggatcaccatgataaacatagtttggtggtttagaatagagtatgggccttggaatcagacagacctggtttgaatccttgttttgtctcttactagctgtgtgatctcaaacacattcttacttttcccaaggcagtttttaaaatctgtaaagtgaagttgatcctgcctgtcttacagataggctgtgaacattaatggtatgcattgaagactttaggacagtgtgcatggcacattgtaagcattaggtaaatgaaccgtatactacaatctttacaacttatacagaacgtagtatacttaaatgttttatatatttgttgttcattgtttcaacattctttgccacattcctgtgacactgggggatgcaacaggatcccatccagtgcagctgaagtgttgagaccgacactggtgacctccatctgctttctgctgcctttcagattgtcatattataatctttcgctttggtgaactagccttttccacttgctgttttccaccatttgtgaactggaaaaataaaatacacaagctgttcaaacattcttagtaagagtaaacagattcggagtgagactgtgaaggggcctgtttctcccctccccgccttttttttggttgttgttgtgagagagtaatggtatgggtgtttcacatccattttcactgttctcagctttacctctctacttcctggctgaggtactgagagtaagatatcactataccatagtggaaatagaaaataacctgctttgataatattgtgacatgtatttgtgatatgcttggcagtagcatcatgttagtgaaaattcctgtgttacagtgtggaatgttggctatcttacctgtagtacaataaacttcattcaaaatcctgtgcttagaatacagcatgatctttatggtataaagaggttttcttttctatttttttccagcacatttcaaggtcttactagttactagagtctaactcaaaagccttagtatttaccctttattttcttttttaaatccagtggtcagaattcccgataccaaaacaattatggatactattaaggtggctgtaatgcttatatacgcactgtgagttcattgagaattcatagttctgttaattctactcaattcttataataattgaaattcaccagcatattgttgtttatagtatgtggtgtaagtgaaattaatacttttcttttaaacattagtattttcagagaagaaccttttcctgttcttctgaattaatgaattgttacaaatttttgtaggtttcttataatgtggctacttaaatcaacatattaaggtaaactcttaagaaaagaaacataatataatgtactccccaaaataatgaatcccatgttttaggttggtatttagtctccacagctggaaaacactattttatgtgatgtataggaaaggctggaggcagacttggtgatttagaatgactcagtgattcatatcctgtctctactacttatgtatttagtatatatacaaatatatattaaagttagtatgtaacatcagaccaagtcatttaaccttttttagcttcatttttctcttgtatataatggaggaattcctgtagggttgtgaagactaaagttacttaattgtatatacacatagccttgtgccaggaatataattagaccatccctaaaaatgctgtttatcatgattttaccctttcaatgcatttattcaatatgatgcttgtgttgtagatgaaatatgtggatgttatgatttacaaacttgaaatttcattattttaaaatactctgtaaagtgatttatgtttgctcatatgcttttatctatgggatagacaatgcaatcctctctgtgtggagacagaggaaggcaacatttccatagtgtgttgttttatggttgactattactgcgagccactgtatcagaactgagatgagattagcactatttgagattttattttggagaaatggttttggctatggtcaagaatcttatttattagaaagaatgaattactgaataggctctcatctgtattctttctacttcagctatagcccatcttgccatcctgtaaaagaaatgctgacagtgacagaggagaaatataaaaatgtttccagttgctttcagtcaaatgtgattgaaattttataaaagatttacacattttttatttgtaatactgacagtactgggaaatgaatttctgtttactccagagaatagcagtcactttataggtgctttgaattttaaaacttagcaagcataacaataatgactggtgtattattaacatgcatgtaaaaggagtttaacatatctgaagagaaactggttaatgttattttacttcctatgtgtttttacagcctttcaagaatgaaacattggtagtaagtttgttttgaatgtttctctatttcatctttgtatgttggtttactacctattgtatgggattcaaagaatgtttatatcaaaaactgttttgtttagagcttatcattaaacctcattacttagatgttttaattacttttatatgtttctttctgtatttctaacacatacaatgagaatttactgttttccattgtgttttacatttttttcttctggtaagttactaagctaactcacatcagtatcttaattcctggagagagacccccatccatttatgtatatcctatagatctgattatggccttgttatggaaattggcctgactacaggcttctagtcattcatgccctagtattctcccctgttaggtaatttccaagatgcaccctctactatagtttctaagtaattcttctgagcaccagaccaagtattcatggaaggcctaaaatatatactttcaatggaaaggatggtagaaattcagccaattctgctttcttgggcttttagatattaaaaagagctatagaaatataattacactgatggatttcactgctctcaattgcctgaattatcagggttgagcaactgaagcgggtggaagggctgtttcccttatatctgaatataacataataaattgtccatcaatagggactatttgagtttgatattgatctttgatgttatgtatgctgcatttcattgattaaaagcatgcattctagttgggtctagatatacagtctaagtacatgatctatagttcagaatagagtatcatttatatagaaatttgcccatggccgtgttgtaattgtagcccattgattggcatctccaaggagcttgtgagaaatgcagaaattttttcctcacgcagatgcactgtatcagaattttcattttatcagttgatttttattaaagattgatagacattgatttgcattgtattcttaactaactgaaacaactggttccctgctacgaagcctaaatgtcaagcatatacacaacctgcttaattgtatagtaaggacccaatactataggatgaaggataggtacagttgagtttggccaaatgatgatcagagtctatatagtttaaggcgcagatacacaaattttcaaaaatatgggtagaatatagtcaatatgaatggaatagacaatgctttgaaaatcactggagggaggctttattgtttgtgaaaacatgttgtcatcactttttgctttaagcccttggtggtgaaataactcaaaccattcttccttatgctgaagatcgagaaccccaagtatcacatctaccatcccactcatcaatgtgattggtcagtctttgctgaggtcctgcatagccagttttaaagttagagttcttgcatatacatatgaaaaggcatgttacttgtgctttcaaagagctttttgcttggtgtaaaaagaaaactcaaattacagtgtgatgtggaatataatggtggtagtttcatcgagatgatgggaaagaattgataagataaagtagaaagatgagcagaattttcagattgggtttggaaagagcacttaagaaagagggtggccaggtggtggctcacacctgtaatcccaggactttgtgaggccgaagtgggcagatcacttgagctcaggagtttgagaccagcctggtcaacatggcaaaaccccatctcaaaaaaaaacaaaaaaatacaaaaactagctggcgtgttggtgcccacctgcagtcctagctactcgggaggctgagttggtaggatcacttgagctagggaagttgaggctacagtgtgctgtgatcctgtcactgcactccagtctggatgacagagcaagaccttgtctcaaaaaataaataaataaaattaagaaagagggtatagtatgtacaatggccatgggcttatgaggaaaaatggcaagtttggagaatgccaaaggtatgagtggacgctaggggtatgggaaggtggcaatagggccttcatttacacagtttcatagactagaatgtgaatgttatccccagagttggaccaccaacaagcagtgactgtgattgttgcatcatggctttgtgcaaagtagcatctctagcgaatgggacaaattggggaatatgagggaattgggagatattctttatgctgtagaaagccactgcaagatttatatgacaaggtatacagtgctgatctgctgaccaatatattttctggcatcattccgtgtttctctcttgtgagtgaggtgcattcctttgctaataacatttgctgtcctcagacattattaaaggaaatttaatgctgtttgacaacatttcaagtagtagccattgatattgtcatggacatttattgttaatcacaggaacaagtttccttttctaacagcaaaatctcttccactgtttgcagtcttgtgtgatgatgaaacctcagcccaccctcctaataggcagtggaccatgaggcctctctgatgagccttcagccaggctcttctccttgctccagtacatcatgcaggcatgtgacctaagttgcaatgatcagaccctctcctcatacgtagaatcttgggcttagtaacataaggatgaagaaatggttagtagatgtatgctttttactgtgtcagtgtcctggccccactgaacatggtgtgtggtccaatattaatggtatctctactgggggttttggagctgctttgtcctctagttcttccttctattccatgcgctctccatatccttttgatagtctccttttcccaaagttggttattctttcttggaaccaaggaactataaagagaaatggaggttcttccaggtaaccctgtttatcctcttagctttctgttagggacatccacagcacgagacacacaagttagcttttcagggtgcctcttgaggcctgtccaggaatttggaaaattcatcctcttaaacagcccatggcattttccacagtttatggtaagtactcttatctcagtattctgcagaatgcagaaaggtaccttgtaaacttggggtataaatctctctattggttttcaagttgtggtgtatagctttattcaaagggaattctaacatttcatacaaccgcagctgccatgttatttcttttaaaagcttgtgccttctctgaataattcatattgtccagtgccttcagattgtttcataagatcaacacctaaaaagtcctttcttgttctagctaatacttaaagactcttttgcaaatgtgtttctagaaattgttatcacagttagggtgggcatttagctttttgtgcctagcctgtaaacttggtcttattaactttgggaaccatgagtcttggtatttatgcagtgagacttaaatctttctcgaaggtgctttatagtaacctgcatgtaaagcctctaacttgggcctggcactcatcattgggttggaccccaatcctgatgatcttcaaatcctctttcatacatagccatcaccactaaagtcttattcagctaatgttagaaacaaagcattgcaggaggcctcatatctagtaaatgcactttcatacccagtttactgttatcctccataattaacgtgaggcataacagaaaataatcatagaccaggcatacatctcaaagcttagacatgttatgaatgtcactccacataccagctccaatccatcattcctgtcctcagcttggaagtggaggaggggagacgtgtttatgggactaaatataaactctgtggggtaattgctacaaaatgtcatcctcagaaacacctgggagctttggaagaaaataaaatttcacagccccacgctaggtaataccgaatcagagtctctgggaatgagttttaggaaactgtagttgaataggctccccatgtgattctgatgttcagccaggtttgagcgctaaagcatgttctgtggaacactaattcttctaggtagatataaataggattccctttaaaagtgttcttaacaaaaacagaggaaattcaggattttaaacaggttttctaacacgagaatttttcagaatctttatgtgcattgtgaaatgcatgtttctgactatggaacaatcttgcttctctatcccccctgccaactccctacccaacacaaagactctttactaaacatctaatgttgcagatttcagccctggctcctccttagaataatccggttaatcgatcgatctggggttgggggtgggttctgtgtgggagaaacaaactcaaagtgtgttttctattctctcactcaaaaacaatcaatagagaagatttttgtgaccaaatttgtgggggaatcacccacacatcaagcaagcaatcagttttccagcagacactaactcagcgtcctctaattcagttcagtactgacactctctacttagagatagtctcagatcacagaggttgagggctcagtcccacaagactgtcccctactcccaatgccacaggcaagcctctggttgcctgttttaatggcatttctaaaacagaccagctataaattggtgttcccgcaacctcctccttgggttcagttaatttgctagagcttctcacagagctcagggaaacacgtttactggtttattataaaggatgttacaaaggatacagatgaagagattcagagggtgaggtattggggaaaggccccacactgggcctttcatgccctttctgggcacactaccctccaggaaccttttgtgttaagctgtctggaagtgcatctgaacgctgtccttctgcatttttctgggagcttcattaggtaggcatgattgatcaaagtattggccattggtgatcaacctcaccctcagtccctctttccttccaggaggttgggggagggggctgaaagtcccaaccctctaattatatcttggtctttatggtgaccagcccccatcctgaagctacccagtagctgccagccattcatccgctaattagcatacaaaagattttcctttggaggtcccaaggattttaggagttttatgtcaggaaatggggtgtaggacaaatacatatattttaccacttcatgggctaatggaatattttaaaatttcccgggtgattttattagacacgcagggtttaggaccacagatgcgatgtaatgttctttggaagacattctggatgatttatttatttaacaatgtgtcccacatcacccagattttttagtttcacatctgtcaggtggttttactcaacttacatatgtatcatcctatgtttagagcttgtttttaaatatctttttttctgattataataaaaactttttcttagaaaaaacaccccagctattacagacactcttagataaaaatgcattggttgtctaagtgaattttaatcataatgagtaatattaattgaacatttataatgtaccaaggaagtcactaaatgtttttattatattatctcatttaaacctataatagtcctgtgagctagatgctgtgatgacccctgggtcctaaatgagaaaactgagaatcagaaagagtaagtaatttgtctcaggtcatgcagctaataaatggcaatactgatatcatatcagatcccaggtatacctgattgtgagctaaagctcttaaccaatttggaatcctggttaagacagaggcttttatgtttagtgatcagtgtatgcttaaaaccccttagtatgtacatgttactttgtgaagcacattttattgcaaggaaggtgaatcttcataaatgacaggggtttaggaaagtattccaaatgttaagaaccattttaaaatgggaagattttcaaccaaatatttgcatatgaatgtaaacagaatttttgtagttatagtagattggtaatttgtgcatgtaagttatatattattcattaatctgaatgtatttgaatattccaaattcactgtttacatatatttttcctaccgataggcttccaaatgttgctaagcttccagaaatattgagtttgatagatttttttggttcctctggccagaaatttaaacaaaaagaaaagaatgatttggactactggcaataaaactcagtgaaggggatttatgtacgggtccgaatgcatgcttattagtcactcagaacatgatgtttcattttaaaagtacatgcctttgcatcttgttatgacatttagaaaaagttttcagttgcatgtctttcattttgccagagaagataaattgactaatatgtaaatgacattacagggtccaagtgtaatggttaattttatatgtcaaccaggctaggtctggatatttggtcaaacatgtctggatgatgctgtgaagatattttaaagatgagattaacatttaaatcagtggactttgaataaagcagatccataatgtggtgggccacattcagtcagcagagggccttcagaaaaaaactgatctcccaggagaaagaattctgctagcagacagcttttggtctctggctgtgacattaactcttcattgcttgtccagtctgttaacctgccctgcagattttgcacttgccaacctccataatcacgtaagccaattccttggtgtgtctctttctttctgtctctctctccgtgtatacatctagtccatcctattggttttgtttctgtggagaaccctgactactacaccaatattccttattctccctgtatgagaaagtttctctagctgtttttagaataattttatttggatgtccttacccgcaaaatcaactgttagacttttgcagaatgattagtgatggatcataccaaatactgccatctccaacactattgatgtttccccaggcattgggcaatttcatagatgccatatagagtaaatgggaacacagaaagttcaaagatggaatttgttactccctggaaatttgtagtggtaaaggtttccaggtgtggcttttgtcttccagtccaagtaggataatttagagaaatgggaaaataatctctttctagaatccacttcatttttccatttaacctacaggtatcaagtgctactaagccgtaggaccaagctagatcctatgggtagaaaagaaaagaagtggatatggaacttgccatcatagagcttagggtgtggtaggggttacccaaaaagagttaaacaattaatactttaaaaaattataaactgtataggggctctgaaggagaaaaggaaagtgctgagatagtgcataatgtgggcaggatctagtgtaggtggcagagtcaagaaaggcttcttggtaaatgtgaattttgagacccccaaacttgagatggagctagccatgcaataaccagggaagaaagttccaggcaacgaagacagcatgtaaggggcagtaggtaagtaagagcttgactcataacctgatttaagttttaatgtacaaacaatcaagttgtcatgggtcaagaaagccttagactaagctgagtgaagggggctctaaatagaatcatataggagaaataacactgggaaaatgaggatagtttagctggattctactttgagagtatgataaaggagaaacattagtttcacactttactagtttttaaatatgtgtaacttccatattatttaaactataacatgaggcatttaggttatatatatatatatatatataaatatatatatatatatatatatatatatatatttttttttttttttttatgcagagtctcactctgtcgccgaggctggaatgcagtggcatggtctccacggactgcgagctcgcttcctgggatcaagcaattctcctgtctcagcctcccgagtagctgggattacaggtgcacaccactatgcccagctaatttttgtatttttagtagagaggagggttctccatgttgatgaggctggtcttgaactcctgaccttaggtgatctgcctgtgtcggcctcccaaagtgctgggattacaggcatgagctactgcgcctggctgataaataattttttaagtatgcatgtgactctcacgagtgtggactgctagctaaggctggctcatcaatatttgtctagagatcttaaaactgagtgaaatactgtctaagtgaattttaatcataatgagtaatattaattgaacatttacagtgtaccaaggaagtcactaaatgtttctattatctcaattaaacctataataatcctatgaactagatactatgatggcctctgggtcctagatgagaaaactgagaatcagagagagttagtatgaggctcctcacactttgggaggctttctctgcatctgaagccacttgaaagtctagactcattgactttgtgaattttaatgacttccttcctccctcccttccttccctcccttcttccttccttctctccctccctctcttctttccttcttttttccccttcctctctttgttccttcctccctcttaccaaatgctagtacagcactggatatggtgaatatatcatttcaggcataagaaattatatgccgtgtaatcccagcactctgggaggccgaggcgggcagatcacgaggtcagaagtttgagaccagcctgaccaacatagtgaaaccccgtctctactaaaaatagaaaaattagcccgatgtggtggcacgtgcctgtaaacccagctactcaggaggccgaggcaggagaatcgcttgaacctgggaggtggaggttgcagtgagccgagatcacaccactgcacccagcctgggtgacagagtgagactccgtctcaaaaaaaaaaaaaaaaaatgaagttgtgtgcacggggacccatatcctccagtcctatagaattgtaagttggttactatagaacttgtgctgtatttggaacctttcactgaagaatataagcaaatgtcaaacctgtaatttgtcagagtttccatttcacaatctgaagaactgaagtgtacaaccttcactctgcattgttgaaatgaagagaaagagttaaaggtaattatccatataatttgaaagaaaaaatgtctccttctgctcaagaagtagggtctgataccttgattaatttgtactggttactaatatttaatttccctggatagtgtctgaactttccatttcagtttgccattgtaccccctttgtattttaaaattatttttctttatcacacctgtaatcccagcactttgggaggccgaggtgggcggatcacgaggtcaggagatcgagaccacggtgaaaccccgtctctactaaaaaaatacaaaaaaattagccgggcgtggtggcggcgcctgtagtcccagctactcgggaggctgaggcaggagaatggcgggaacccgggaggcggagcttgcagtgagctgagattgcgccactgcactccagcctgggcgacagagcgacactccatctcaaaaaaaaaaaaaaattatttttctttaaaggttatttgtctatgattgtgcattttaatagtatgaaagggtacctggtcaaaactgtttgccttttgtcactttctgctaactcttttccctagagacaatgttactattatttgtttatcatttcagagatctttattgttatatgggcacatataactgattttgtcagttaaaaaaatctgaatgcttactataaaaaatgatggcatggaatatttttcttcacttaaagatgaatcttagatgtcagtctacattaatctatatgtagctaactcttccctgcgaagagtatttattcctttgtacaaaggccataatactagaacttgctcataagaatttatgttctttacagactcttgctatgataaacaatatctttgtaaacatgtgtgattatatctgtaggataaattcctgaaagaagaattggaatttttttggtcaaaaatactgtattgtacatttaaaaacttttataattatttccagattgccctgcaaagaaattatcataatttacattctcaaaacaaggttgtcataatgtttgagttgatgcagtagctccttagcaattaatagacgttcattttacaatctgtcaacatttgcaactttcacgaagcctcacaagtgatcgtgtacccaggtaaaacagcttatgttagacattcttgtgcaaggtttatggttggctgttgttcttaatcctttccagttataagagctcattgaatgtctcagttcaaggttgccatgttatattatgagacattgggtactgtcggtgagacttggcatgactggacgagccattctgatctttgaattacacagcaagtagaagccaggacagtatgttcttgacttaaggcatcctcagcaaagtgataacctagctgatcttctgagaaccctcagccagacacagtggagtttatggtaaattatagctcttgttgagcattgactatatgcctagcacccttgcatatgatttctaatctttacaacaaccctccaaaatgggaataactatcctcactttacaattttggaaatttaagttcaaaacggctgagtgcatttctcaaggtcaaggtcacataactaataattggcagagctatctccctctgcctgcttccagaggagtttttccttttattgcatcattgcaattgaccatcagaatcacttggctttactaattttttatgcattaaacaggtttttctggtcagtatccaggcaaatttaggcagttcttgtttggaagggtcctttcctttggttggtccagcttttgcacccctgtacttagagggatgctcagatgctcagatgtctttgctactgctgtgtccagctgtggtgtatcttcccatgctgaccctactctcatgtttctgaactgacatctcgcaagattaattgagatgctgtagttttctagcgctacactggctgtaattagtcgctgacatatgatgatttattataggggattcctttagaaatttactttgtgttttgggactaagaaatgatcgttagagtttcagacttacagctcttgtcctgcaccacttaactgatcaaaactatgtttgggatgaccaggcagcttgacatcatagcactggtcatcctgactctctaagtaaaactgaaatgtgtggcaaattaaaagcagtgaagatggtgcatggctaaattaattcatcttgattaggccctggtgaatttttaaatatataatcagatgtgagaatttaagatgtgggatagtcaaagccaagaatccaggaagacttctagcaattccacaaagacaaaaagcaaagatgccagaagactgtggccaggcttgcttgtggaatgaaaataaggggaaaaaaatcacttacaatagattaacagtataccctgtcaaagagtgtgccagaagtcacgtaaaattcccaacccactgacagagattttggagaggtgatgagagtgaggggaagggattatctgaaaaatatgaacaaggcagtagtgaggaataagatgccagcatcaacttccgctgtcacttgttttctcaacggttagccatgccactaaggtcaactcagtatgttattaaaatgggcggttttaggtaatgattactttcttggcagatagaggattcttttatctttggggtcatgcatttttaaaagcctttgtctgcatagatttatttaaaacacacacacacacacacacacacacacacacacacacacccccttaagcaaggtatgctggctcacacctataatcccacactttgggaggctgaggcgggaggaccacttgagcccaggagttcaagaccagctggagcaacaaagtgagctccttgtctcaacaacaacaatgacaacaacaacaacaacatctgggcatggtggtgcatgactgtgatcccagctacatgggaggctgaggcaggaggttcccttgtgccaggaggttgaggctgcagtaagctatgttcatgctactctactccagcctggaagagagagtgaaaaacaaccaaccaaccaacaaaaaagcagcttgattgaagtgtagttgatgtacaaaaatctacacagatttaatgtatacaatttgcggattttaatatatgcaaagatgcatgagacaatcagtacaattaaggtaataaatatatctattatctccagaagtttcttcctgcccccgctccatgtttttactggtaagatcacttgacatctacttgcttgacagatttttaagtgcataaaacagtgttgttaactataggcactatgtcgtgtagcagatctctagcacttattcatcttgcagaattgaaattttataccctttgtacccttgaacaataactctccatttttccttcctctacaggctctggaagccaccattctactctttgtttctatgagtttgactattttagataccttatataagtagaatcacccagtatttaaccttctgtaactgccttatttcacttagcatactgtcttccaggtacatgtatgttgtcacatatggcaggatttccttctttttcaaggctgagtaacattctattctctgtgtgtgtgtgtgtgtgtgtgtgtgtgtgtgtgtataacatgccacgttttctttattcatttattgatagatatttaggttgtttccatatcttgactaccgtgaattaagtaaactccaatgatcatgggagtgcagatatcacttctagatctaaatctttgacatcttgacttcaattcctttgggcacagatttctatgaagatttcttttttctttttctttttctttttttttttttttgagacgagtctcacactggcacccaggctggagttcagtggcaccatcttggatcactgcaagctctgcctcctgggttcaccctttctactgcctcagcctcctgagtagctgggactacaggcgcctgccaccatgcccggcaaattttctgtatttttagtagagacgggttttaccgtgttaagcaggatggtctcgatctcctgacctcgtgatccgcccgcctcagcctcccaaagtgctgggattacaggcgtgagccacagcaccaggccttctatgaagatttataagttgctcagtttttatttctggtgtgtgtgtgtgtgtgtgtgtgtgtgtgtgtgtatgtgtgtatgtgtgtgtgttttaattttaaaaaccctgtcatatttaggatatacctcgtgatgagtgtgatcagcactaattgtcactctgttatactaaaagctctttccgtagtgtgtcttcattgcaagcatccattgtgtatggaatcctgaatacagttatttgaatgtctgagtattaaacaattaactgtctttacagaatgtcctccggggaacatagtttttccttagggacccttgggatctctaaccgcttaaaatctagaagctcttatgtgataggatgggaaattaaaaaataaatctctactatatgttaggatgtccatactgcatatagctccttaagataatggactatgattctatcttgtctctgcgcccagtacatggcacatttcagggtgtcacagatttcctaggattaaaatgcttagtaaatatatgaatgaattctaattttagtttctttatctggcaccttttcttgtactttctgagcaataagaagtaggtatctgggtttctagtagatttatgccatataattaagaaatattgatttaataatttttgtgtcctgtgaactttatttaatcattagctaataagatttattgagcatcttgcagttctgtagccctgtgcttgatggtgttagctccttagcacgtaattgttttgactagaatggtaatttaaggtaatttgatatacaaaatggagtgctatgtatggcaaagttgagagggggtgaggagaatataacttcaaacctgtttgaaaactcatcaagtaatatttttcttactttaaatgtgctttggcctcctttgtgtgcaagcaatagagacctatttaggctcctttaactactgggggtttatcaaaaggtgaaatatagaaataaagagacgagaaatactgtccacatgggagattctgatgtgaattctgggaaagctgcacaagtgtggcacacctggacctcacctagatggagggtggttcgaaactagaaggtcctttgtgacttttgtctgatgaggagtcctagcagtttgaggatccagttttcatagttacatagttaatttagtttaatgacttattctgtctttttcatctttgtggtttgcgtttttctcctttctcaatgaattgctagctctcttctcaagagaagcctggattgcttaagttaccatcttcccacctttgtgggcagtgcccttgctggagtccacctgataccctgtggatcagctgccctttgtcgggttcccatcacagccccaatgtgctgtgggtgaaggggtggccagggtgttgagagagagccaagtccatcagagaactttcagaagtaccttgctgtgaatcatccttcacagcctagtgggtgccgctcctcccttttattcaattttttaataaactcaatatttgatcaaattaagtggagggagggaggatggaataacatgctcctgatataatggaaaattcaggctcattgaacttgtgtgatgtgccacaatccttttagaacaagaccgtgattgaaactagtctcttttctctattacttttttgattgttttaaaaaaaatcaagaatatttctaaaatataaaaaaaattacaggagagataatttgagtatcttcactttttacactcctgccaagaatgccccacaaccccacccattacagaaggatcagattccatattggaaatatatgccaatttcaatttagctgctcagtaccaagaattcttgcacctatgagatgctaaaggtttgaactaaatggagccacattcatcattgttgtagaaatctgccagtgtttaaaaggtgctacagggaacctttaagtcatgcaccaaattaaaagattgcaagctccactggtgtagtcaaaagcaagctcaaagctgagtggcatcaaaccaagagtagaagataacttgttactgaattttgttcttcctctgaatgccactctttcaagcagagcgaggaaaatatgaattttgtgttgttaaaagatgtttatttccacaccctaatttatgtttcaaactgcaggcttttgcagagagtgtttctctgaaacttttaaagaaagtgacatgttactacatgggaagaaaagatagagcctggttggtaatgattatacagtcagggctttatctgcttgcagataatttgtggcttatttttaaccgtctgccagtttcttttctcattgttacatttacctgctgattgcaaccctgagccaatcagtcactggtgagcatttggtgaattctacttttttaaactggccaaaagaaaacacatatttccagaatggacacagtgatactagctaatatttattgaatacttattatgcagtagattcaatattttaaatttaacatttacagaaacctcaccatagcaagaattatcattactgttttactgatgaatagggtgaggcttagaaaggtaagtaacttgtcaaggtcttaaaggtagtcaatgtcagaggcagggcttggatccaggggaaacctggtcaattttaatcctgcactgagaggtgatcacaatctgaagactgtgatcgacactaagacagattttgtcaaacaagctggtatcatgaggaagtcagtttggatgatgatggtatcccataacatgtctcaagaagaacttaggatgtttagcttatggtggtgtaaattcagtgcaaggggatgtaataggtgtcttcatttacatgaaacaatttcaagcgaaagatgacttagatctgctttgcatttgcacaggggtgagatgtaagacatattaaagaaaaccataaagagccaactgaatgaaatgattcatcaataaatgtgtttcctcaacgtatagtgagtgtcctatcaatggaaactttaacaaaggagctagattttggttttacaggactcttagatctatggattaagatgtgtctgtaatattagatgtatcttagagaataattatccaaaatatacttcatggaacatggaggaactacagactaacattttctatggtaaaatatttgggaaatgcttcattttttctttcataatatattaacacgttaaaggccaaatcaactatttaggaaaagaaaataaaacaaaatttcaccaactttatgaagctaacatttcctgagctttaacatttttcatttgttattattttttgatactaggaaagccttcttgtgatactattaagatcccatagaacattgcaaatgcttgtccaaacctgcaaaaaaaaaaaaaaaaaaaagcgcacatcatgtgcagagacttcccatgggcattgggtgcagctatttgtaatgagaaacaaaataactgttggcttccgtagtggacttgtgagaaccagtagttttgcatggtgcagggatagataagaaagttgttttcgatatgctattttggattctctcactctaggaaataatcaagtgttgatggtattaaatttcctttagcatacatgcaaagagggcatgtttatagactttgacttgaacttcttctaacaggccttattttccctgagtatgtttctacttacttaaaaacagatgctctctgaaaaattcatgaaaaccaaaaatatgctggagactttggagagaagctcttcaccctgttattaaagttagattgtttctaacaatttttttttgcatcttctgcttggcagttaacttcatgaccttgaacaacctttctggctttcctgtaactcagtttccttcatttacctacctacttaaccagattgtacataaaaatacatagtatatatataaatggttatattaacagatagatcctttcaaacacacttatattggtggctttgttaatgaatattgcatttgtggcagatagacatgtttccttaaatgaaggttttcaaaactggcattgtaagtaaattttacatattatcagttgcttgcacccaaaactatttctactgtgaactggaatacatcttaagaaattattttaaaagatgtaaataactagtggtaaagtgatagagcacatcataactttcttcattatcataagtaatgtggctttgtccatatgttattctcatttgaattataattcttatttttattgtatgggggtttgcacacttttgtcctcaacttttcttgtttattttaaaaagggagtctcaggatttttcttctgaagttaaaatttaaccctaaagaaagatgccacagtagtttagtctgcttttctggagctctgaaccattgagggccagaactgacactataagcaggagcagcagtcccaagatgggattctaatatcaacctttgttttatctgattcactatgagtaagaggatacaatatgagtgaacagcaaacctgtgagaaacctacaagtataaaaccaatggtatttaattcaggtaataaaatagaattcttaaacaccctctaaattaaaaagccagaagatgcagttctaattacatgccttaactagaagtaggatatttgcagcttatcaagttttatgtaaatttgttcctttggcacaatttgcctatataagcagtattagttcagtataaaatgtttattagttattgaaactggctctagtgtaatttctgtgttttaatacatagtcccaagttttgtgggatccctagagagaactgtgtggtgtctatgttttgaataaacaggttttttgaataatagtaacttacatatctatagtctcttatctgaagcccttggggtcaaaagtagtttagaattttagattttagaacggtagtatgctactagtgctgtgtgctatgtgacattccaatagaatcttgggcaatggccaagcatgttgacatttcttagtgcttgaatgggataaagatcataaagagcatctttttcagctgaggtcaggttgggctgacagtgtgtttggttttccagagcgttttgcatattggaactgcagataagggattatggacctgtaatattaaatataatagctgacatgtattgtgtttattccaagccagacatggtactttacttgtattatctcatttaatctttgcaactctttgaagaaggtgatagtattaattttgttttacagatgaggaagagtttcagagaagttaagaaacttgcctaaggatacatacacctagtaagaaagtggtagagttacatctcaactaagtcgaattagacaccaaatctggtgtgcacaataactagttatcctcctcgtattcagtgtctctgatttgcagcccatagactcagtcttacatcaacataaagggaattaatacgaagggtatcaggtgatggagtatcaggcccaggggataattgggggaaagaatgagtctcagtagcaacacttctttgatagtctttcttggccatttccattagaataaatatacttctagtagcagtaagattcagatgagagagaatacttgagcttgtgttgctgttagctagggtaaagtggggtgtcacaaatccagcatgatggagcagtgttcctaaaggaaaattgattgctgtcagcaaaagatgtgattcacgtgagacagcacactcatgtaaaatgtccactgtatggatgattaattaattgcagatgaaactaacatttggatgaaaaccccagttagttttttaagtataatccattttaagtttaccacctgcttgataccagcaaaacagttaacttatcatcttgaatactcagattcctgtggcagttcagacactttctaggtcttggatctcagatctagaatcagtgagcttttttcttatttgtaatctgagagcaacagtacatctcccaatttacctagtgggcattgtgttagctaagatagcccaaagagcttctggaagttcataccctatgtgttcatatttctcatgctgattctgtgttgttcttgtataaccagcagatgcagtaggggagatcctgcataacttctgtggccaagtcataaggagccttgcagtgtccaccttattttcttggcatcttcactctaggggaagctactgccatgtaagaagtctgatcattatgctgtgaggaagtccaagctaaccacgtggagaaagatcaattcctggccagccagctgctattctagctctcccagctagtgtgccagacatgtaaattaccttggacatccccacccaaccgaaccattagttcatttcagtctaaagtgccatctgactgaaatggcatgaacgataccaagggacaactgcccagctgagcccagaccactcacagaaacacgaggggcaataatccacggtaataagtcactaggtttccccgtagtttgttatccaatagcagatatccagaaacaggtttgctgtgaagaagagagataatgtgttatattcctcaaatgaaggtgagcagctgttttattataattgctttgacaatccagaaagcaaggtctttctaatatcctcagaggtttcattacaatttgccattgtgatgaggatagtgatcatgctgtactctctggacagggatggagagtgttagtgattggccagcatccaagattgtcatcatttttccttagtgcaggagtttaaaacattctgccattttctcactcgtatttatattttcacaatgaatggggttttctctaataagattactgtcataaagtctcttatttaaaacttctgatggatcctcattgtggatgacagggcccatttctctgtttttgtagactgtccctctgtccagaaactacaggggaaataagatgtagattttgaaaaagtgacagcgagtcaaagaacagttggtcaaacagcttcccagcagttgggacaggctgccagagtgaatgtcaaagagaagttggttcttggatggttttacagaaaaacaagacaatgaaacaaagaaataagaaataagtaggaggcatgcagagggacaaaaatgaaggacttgatattaggacaccagagcaatcagtagtaggttggataggaggagttgagaagagggaggaggaagcaactaagggttggttggaacttcaacacttaatgggttcactccctcctgtctgtaattaattctagctttagttacttcattttctccttagaggaagataaagtgacctggactatcttctttatgttatagttgtttagaatcaaagggcattttcttaaagtctcttttcccaagtaattcttaagatttcttaagtgtcattgtctcttcaggtggagtcataaaatgcatctctatgaggggcaataaaatgcatggaggtgccttttatggctgttgctagcagaggactagaataagataatgatggtattttgcaaatagtgataaggagcaaattgcacattccaatgtcaatctgttctcaaaagagtatagttcaaagtttctacaaagctttttgaaagcttttcttttttgaaatgagtctctgatttctgtttttcctagctatacatagattttattttggggaaaattttaggtagtaacattatccttaatatttactgatttgctgtagaattttaaactggacaaatgaaagcccttgaggaagagaaatttatattctaacatagcgaaataaatatatgtcttgcaacttgaattgttgttaggaaattacttgtatgcctgagttcatgaattatttaatttaagattattttcctttttctaatttatcactggctaggtcctttaacaatcttttgatttattaagagtcattttccagaattagatttaaagctctattgttttcttatgattttcctatgaaaattgagtatgtctcctataaaagctatatttctcttgtttgacttatttcatttctctattatgaaaggcaatcattttaaaactgatgaaattttaaaaaattgacctaatctgaaaaaaccagcccatttcatgatccttcttcacttattggaaaagactatggagtcaggagttggggaatgtaccgacctccattaagaggtaaatgacttgcttgtgtctagaagcgtttgtgtcatttgcctctcagtgcttgctgcagttttaaggaaattgtcctcctattaaggttatgtatcagaatcacccttgaaactttttattaataaagattctctgtccccacaatgaggtttattaaatcagaatctccagggcactggtgtgctgaacgagtctcctaggtgatttgaattcgtaccccagtctgcatctgaaaactgccgcttttcaaagagaggcagacaggttgatggatgataggatccagtctgacacatggaaaagctacaaggagggagcatggaggaatccttcatttagggagacatgagtattgtgaatgatggtgtaatcactgctaaaaatttctcgggtttctaagaaagttttatgtcctcagttttcttgatggtgtctccagccaagctgtaatgcagtggttcccaactaggggcatcttggtctccaggggctatttgacaatggctggtcctatttttggttgtgataactaaggggatgccgctggcatctagtgattagaggccagggatgctgctgaacaccctcagtgcaaggggagccctgtgttagtcagaattctccagagaaacagaacatatatgatggcccagcttatgcggcagtcatgtgggagttttctcttactcagctttttgtcctcttttgatctccaattgattgggtgaggacctcccacattatggagggcaatctgctttacttagtctggagattcaaatgttaacctcatccaaaatatcctcacagacacacccagaagtacatttgaccaaatgtctacacaacctgtggcccagtcaagttgatatataaaattgaccatcacagccccttacaacaaagagttatcaggcccaaaatgtcagtagtatcaaggctgggaaaccctgatctagtgaagtgcagtgaaattctcaaaataaaaatattctaggggccagcattgaaaaggatgtggcagggccaggtaggagagcattagagatggcctgtgtggaccttgaggaagccagatgagataaagaggaggagagggcatgaacataggataaaagctcgagacaggaagagatggggttaaaatgaacatcaggtacttgaaaagagggatgttcatcaggtgttatttttcctagcagtgttatgtaaaatacgagtactatctgaaagtctgaaaaaggtagggccaatttaacatcagctttaagatagtaaatctctattctgtaagatgtaatggtagtttttaagccttgaaaattggaaatgttagacaatggtagcatatgtgagccagagagaatttgatggtaaatttgtagtacagaactttagacttgtttttaccaggaagaagcatcagagaaacagtgagagtaatcagcgcatatttgttgtatttccgaggctggtaatggagctaaagtgtgggggcagagctttttgtttgggaaagtgtggaaatggggctggtcaatgcagatgaaggggtgctatgggaaccttatgatgtaaaatacactctctcattgtcttcacaagtgtagctctaattgcctgacctatgtgcagatttgttgttcagaacaaatggggttaccataagtatggaaaatggttcctggtctacagcgaattggagagactagagaggcaagccagtgctcttaaatagcagtgacccatctaagttcatttttcatcacccttctggtaaatacttcctaattttctctaggggatgtgctttccccatgtttgatctgtttttttctgagaggtgtttggttcatcctggttgtagggttgggtttgtgatataggcatagcctctcagaggcatttggccataagtcttatctgggtatgggctcatgaccccaggtcaatctagtcagatctgctgatgttaattctgaggctcttttctttccttacttttgtatttggaggtgtaaggatgtaatcccacgttcttggtcataatcttgtcatactatagaaagggactttttcaaaatgtagttaattcaaggaagaccagagttgagagaccttatatcatttgtgctcctggatgaagctgtacctgaagctaggttgtcccagaattctgttagtaaactattaaatttcttttttggttatactagtttgtgttgtttctttcactaatgactgaacaaattactaaaagatacactgaattattaggagaaactgtccaattagtaagtgatatagccaactaataactaattaattaatgtttcatactccagtatttgggctctgtgtatatattggtgatattcttccattcttgtttgtttgtgttttggagagtttgacaaaaatgcataggctatctctggtaatgcttggtttaaagcatatttcatattcagaaagatgttgtatttgagaagcgacgtggtaattggttttgagagtatacatcttagacaattaaatggttacattgcttccttccttggtttaaaaaaaaaaaaagaaatccaagggtattccagttgtataaatagggacaacacagtttatgctatttgtaattacagataccactcaaaagaattgattccgtttacttttgtattagtgtactgtggaaagtcgttaattataatgtctgttcttatccaacaacatgcaataagtaaagatgaaaatatagagattattagtttgaataactggttgcatgccatccggttttatatgattgctgaaatgcaaaacaaacaacccctccccccgaagaaaacaacccaccgttcttaaataagacatttgtgacataacaaattagaatctaggagaaggaaaatattttcccagtatctaaagccattgaatcaaaataatcgtgtagatcacactttagttcagatataacctaaataaattctctagccagggcacccatctgtcaaaaaataaaactctggccctcatttaaaatggctcctttagactgaggtcatctagctgtatctaaattggacatgaaatgtcaatttcataccttatagtggcacatttcatattgctctacttaaggttatgtcagctttacccataaaatgcaagtgatttaggtcttattctaaatgaactaaccagatacatcagcaatgggcactgccttgccactgcagaaaaagggaatgtgtgaagggaagacagaaaccacttattctgtttcttaactctggaagtataggtattccaggttgggatgtcttgtctatattttcattccttgtgaatgataatttgggggtggggggattagaaagatgctttattcaaaatgaattgtattgcctgcaggcgattcacttgcttaagttatatttgtgagttattgtatgtaactttatcacattggaaagtttatgaaccttgtgtagaaaaaagattgcattttgggagctatgcacatcatggctttttcacaagtgacagaaaagtgctgcagatgatttaagcaggaagaaatgaatttttcgaaagattttgagtccagaagggagatagggcagtcagtcttggaagatgaaaaggacaaagccaaagcgggccaggcaggcaagggagtagtgttgtgaacgccctaccccacccctactgcatctgagtgttgcaactgcctgtgttgccactatgtaaacactgctccttaatatctgcttccttggatccgaattcagagccctggggacagtgcatctcattggctgagcatgtatcagccattggtaaccaagctgcaaagaggctgggaaagtaagtagtcggctctttcagcttctagctggaatgtgatcacctcccaatattcttcttcttctttttttttttttttttcgagacggagtctcgctctgttgctcaggctgaagtgcagtggcacgatctcagctcactgcaacctccacttcccgggttcaagtgattctcctgcctcagctccctagttactgggactacaggcgcccgccatcacgcctggctaatttttgtgtttttttactagggacggggtttcaccatgttggccaggctggtcttgaactcctgacctcaagtgatccacctgccttggcctcccaaagtgccgggattacaggtgtgagctaccgtgcccagccccagtatgtcttcttatagtggggggtatctaaaaacaggaagaagtttcagatgcttggcagctgacatggctaattttaggtcaacttgactgtatcatggggtgcctggataaaacattgtttctgggtgtttctgtgaaggtgtgttaggttgagatcaccactagaataaatggacttagtaaagcagattgtgagtggtcatcatccaattcactgagggcatgaatagaacaaaaataccgaaggggaaaaattaagaatttgtccctttctcttcctgcctgctggttgagctgggacattggtcctctcctgccctggaactggtatttataccatttcctggttatcaggccttcagacttgaactggaattacaccattagctcttctctggatctccagcttatagatggcagattttggaacttctcagtctccataatcatatgagccaattctttgtaataaattttcttctctctctctctctctgcctatctatccatctagttatctggatatatcgcctatgggttttctttctctggagagctctgactaatagagtagccaaagcaaagacagtttgtatgtgtatggttttatggggagtggattttcaggaaagcaggaaaaagattttttccagggcacttgggtagtgcatcttttttcctctaacaaatgggggagcatgtggccttctgagtactgggtttgcttaatgaatcaggagagccagtgtttataaatattcctttaaatggcagagcgtagatcctggtttgtagtccccttagtatatttgtaatgttttcatcatacccctaggccaaagaaaatactcaacattaagtagttttattcattaggtaggtaggttgaaacaaatgaataagaatttatgtactaacgtaatttgaaaaacatatatatcatttgaaaaaacacacaaattgaaataaaatatttttttcttaaataaccactattgcttactaatgggatatatcctcctgttgggcacagaatgacttcacatacattggaattagattggacactgctacctgattcccatccacattgattttcatgacgcacattttattacagcaatggctatgaacccagctttgcaaagatataacataatgaaaaggaatgtaatgcaatcaaatattgaaactgccaactacctcgagctatcctgacagttgagcatagcttgggagtggtagacatagattatcactgaaattctaatgtgagcctgatggcaacttgagttgaagggcattcttgcaagactgcttggttggggagtgtcacaccagctggatgtttccagaaccaagggcctgggaaaaactatgccagtgtgcacagtgcacactcttcctcagtgtagccactctgcttctgatgtgttttgttgtctaaatcagtcagcaacctatcacagatgtgtgcatcttttcctaccaatccacaaaacccacctgatacggtttgtctgtgtacccacccaaatttaatcttgaattgtaatccctataattcccacctgtcatggggggcacccagtgggaggtgattgaatcatggacacaggtctttactgtgccgttcttgtcatagcaaatgcgtctcacaggatctgatggctttataaagaggagttcccctgcacaagccctcttgcctgccgccatgtaagatgtgcctttgcttctcctttgccttccaccatgcttgtgaggactccccagccatgtggaactgagagtccattaaacctctttttctttataaattacccagcctcaggtatgtctttattagcagtgtgagaacagactaatacaccacctgaaataatgtaccccttaaaatccttatttatggattgatgagaaaacagagctttcattttatatgattaacagaagataagtgcctctgttgcccagatcagactgtcttagttcattcaggctgctataacaagttaccattttctgggtagctcctaaacaacagaaatttatttcttacaattctagggtcttggaagtccaagatcacggcaacctcagacacttttggtgagggcccacttcctggttcatagatgggccttcttgctatgttctcacatgggtataggaggtaacagagctctctgcagcctcttttataagggcgctaaccccattcatgtcctaattacctcccccaaagccccaactcctaatagcatcaccttgggtattaggatttcaagatatgaattttgggggaacataaacattcagaccatagcataggccaattaagaactaggtatatgtaaaagcatggctccttttttggtacaaagctggtgtatgcctcaaaatttatattttgcactcagaaaaattcttccttttattccctgaactgcttgttcatgtgatctctacttctgtatgtccaggtctttgatatgtgtatgagttgactgtttcattgtgtcggaacatcttttgattgtgtcaagagttccagcttcttttctttaaagatcctgttttataatctgccagcctgaccacactcagcatacagtcttcaaagttacaggttatgtgaaactttcaaatgagatattacttactcctgttcttcagctggaatatcagttgctgggggagctggagaaacaattcccaaaatgaagagcaccttagcatttctacaatgttgtcattgcagggtattgtgataggcagaatgctggccctgccccaaagatgccagtgtcctaatctctagaacctctgaatatgctacctcacatggcaaaagggactctgccaatatgatgaaggtaaggatcttaaaatgaggaaaaaattctggattatcctagtggacctaatattttataagtgtacttgtaaatgaaagagaggggcaggagttgtgattatgtgattgctggctttgaagatgaaagaggaccataagccaaggatcaaggtcagtccctagaaactggaaaagccaagaaaacagactctctgatagaccctccaaaaggaacaggaaggaagccctgcccagtcttaattgtagcccagtgagacccattttagacttctgatttccagaactgtaagatagtaaatgtatattgctttaaattactacatttgtggcaatttgtcacatcagtagtaggaaatgaatacagctataaagtggaagaaaccatagaaagttcactgagccttttgagattaatctttaactcatattctaaaatcatatagctccctgagtgtcaaactgataactacataatcacactttcactgttctcaggtttactacaagcagaattaccccatactggtgttcaggcagatgaattctcactatgaaatactttttaattggcgttcttatgattgcctccaaaatgtttaaaccttttgacagttgcatccattttatgaatccatcttcagtaataaagattgaaatgctctaaaccaccaaaaattagtggcttaatcagaaactgagggtggttctataaatccaaagctgctggtcattagacctcactaccatcattatgtatttcttcatcctgatgcatctcacattcattttttgacacgttaatgatttctgtcgtaggcatattaactgtccacatgtaaatgtgatggacactgctttggtttagcatggggctatttcgattggtcatacagccaaagaaggaagtaaaggatgtaaacagtgtgggtgcttatatttttttccaatatttgtggaagcatctgtttctacatatgactggcacaaatgatatctttttgtaaaatatttcataatttctccaaaatataccagctttctggttttgtttttagagctagagactttgtctgctctcctgactttttgatattctttctttcctttttttttctttcttttttttttaaagatggcatctcattctgtcgcccaggctggagtgcaatggcatgatctcagctcactgcaacctcacctcccaggttcaagagattctcctgcctcagcctccccaatagctgggattacaggtgcccgccatcatgcctggctaattttgtatttttagtagagatgggctggtctcgacgtcctgactgcaagtgatctgcccgcctcggcctcccaaactgctgggattagaggcgcaagccactgtgcctggctgatatgctttcatttttcactccctttttaatcttcccctccattaccagttaacaaactactacagctgcctctgcaaatgatagaagaacaaaaattaggaggagagggggctggaggaggagaagaaagaagcagagaaggagaaggacttcatagaaactacggctgctttcaggcatataatgtgagatcttgagagagaattaaggagtgaatttccacgtaactttcaaagattgtaaataggctgcctctattttttgcaattgccaggcaatgacagtgtactttacttctactctcctctgaaggagcaaaatgagtgctctatggccttaacctctatttctctcttaactggattcaaacgtatgtcatgctttgagccttcattacgtaagcgatttttctcaaggtcactgggagcaccacgttcactgcctctggatggttcactgtactgccgtgcagccttgctgaccatttcatgatttggggttcatgttcattttatagactggatttttttctgttttacgtttcccattttctttgttacttagaattaaccatgaccagatcaattaataaaatagttcaggttgtcttattctatttgtgcatttggtttgcagttaccttcacaaatattctggtggctaatgaagttaaaccaaagtttgtcaatctgattttacataagctgtgtgccaaaactgtgttaggttcaataatgctcattttcttgtttaattttcacaacaactaagaatattatcagattcatattctccttagataattaataattaatcacattattattctcctgagaaggaggtgatactattctcgatttagacataaagaatcttaggctcagagaatcaccagcagattgtaattttgagcctagatcatcaatgtctaaattcttgctcctcttattataccattctactaatttatcaatgataaatatttgttaaatgcatgttgtgtgctaggcattgcaccctgttctttatttacaaacatatgagttattattatctctgatttgtagatgaagaaattgagtttagagttaaatgattgcccaggattatgttgttacaagtgcagaatcagtaatcaaattgctgtgctgtgtcctccagggcctgagttcctacattgccatgagccattaaaggtaagatgctaattaaaggtatccatgactaattttaatggctaacacaagtttggtgaaattgatttaccataatattttggttactttttagggctactcagatacacatacttgaactgtaacagcaaatagtgagaggggaagtaaagattctgagcctcctttctgggtttacagcaatattttgaactaagaagatgaagtagaattagacatgagcaaagctccatccctttcttctgcaggtgagaaagaaatagagggtgtaggaggtaagcatacctacctagtaagccttcatgatttaggtatctggagcaggtgggactggagcaattgccatgaagttcacaattttagtgtggcctgtgatctgtttctttggctacagcttacatatcaggcctggggatttttctggattctgaaggttctagcttccagccttgaaattattctcctacttgtaggtcagtaaaacaagcgtttctttacttgaaagttttaagtcgacagttgccatgataaatcactcccactgatagtgttttagactttgttggttctaccttacgggattttcatagagtttctaaaagagaaagacaagcactagagtgaagaattgttcttattgtggaagaatcatcaaccttggctggacacacagatcaaggggttcagggatgggtggcaaaggatcattgagagggttacatgtgacccttgcctaactatagtagttaattcaactctgcctacacaatgacacggattaccgaggatatgacttgtattatactcatccctctgaccccacatcctaatgttaataatgattcttaaacctggaattgagaactcaaatataaaccagtgcccagcacatagcaagtcatcaattaagtttattgaattaaattaaatattggaattgtatctgtcaaagccatatcagctctaagcttcttaagagaaaaatctgcccagaatttctcaggagggatttctcaacatcgaagctgtcctgttcatattggatttattgtacttacataaacaggaatacacgagcagggaagatcagatcagttaccacaataagggttttgtaccatgatatacatcattttcgctcccctaggaaagcactgctgatgaaaacaattttggagggaggtggtctcaacagagtagatgttcaggtggaggttatctctggtgctctgggcttcttattcataattttctcttatgaaagagagtggttttcaacttcacaattcctttgctcatttggaaatatagtagcagaaagatgaagagagtttgtgacccacaactaaagtctgtgttctcttgtcacttcatcaaattagttctggtggcatttggttcccccccagaaataaatcactgttaaatgattctttataaagcagtccacacatttatcataccacagtgatctgaacccatttagggaattataagctacagttggtcatgttgcaggcctagcaactctggccttgtcacattgcatctctctccactccctgtgctaccactaatccttcaggactgagattcaaggctttgctagtaagaggcttggaaataatcatataaaacataatagtgtggcaaggtgagatcgagcttttaatttttttaagttcacagagagcaagaagacagataggaaaggaccggcagattgggaaaaatcaggaataagatgaaatatcctcagaactttagcttttatgattccacctcacattcagtttaattatgaaatttactggcagtgacaattggcttttggcataaattaatcatgccaagcattatacatgaaatgaaatttcaatcctatttgttgaacattttctaagagcttggcaatcttgcccagcactttacgtagggtttctccttatctaccttatgaaatatgttattattattcccacttttaatatgagaatatttggggattagaaggcttaagtaatttgacaaaggtcatatgggctagcataatagactagaaaacaaactcaggatgctgtaattactacactggaatcattcttagttttttttttttaaatgaagttggcattagttttgttttttaatctttaatacttttatctgagaattgataattaaccattttaagaaaatagttacataaatttagaaatcatttggaaaacaggtaaaattgctacattatttcaatttattttatttttaaaataaatgatattttttatctatatttgagggctatatgagaacctaagacttctattgatgttaattattgacttttatttactgtagttttagtgaataatttaattgacttctattaattcagtcatcatatgctaaacctagagtaactgctgttaatatttttttttttagctactacaaattgaagtatttttgattagagtaaaatttatttctaaaggtaacctgagtaatatctctatgttgtagatagatattactatctatagtaatatctatgcatatagtatctatgtagtagctttccaatttattttgctattatctaaaataagaaatacattttatattgttccagtaaatgcacacatataaacacatatatatgaaattgatacttcataaaatattagttacccttattataatcagtgctcacttgatattttacattttatcccattgtaaaatagatactggtcatgactcacagtattgatttcataactccctaatggttgtagcctgcagtttatcatttgttcaaatgtagtgtggtgggaaagaaagatgatatgactcttcagacagagaggtctggtccctaccctgatatgtgtcagttatatgtcaccttacctataaaatggtgattatcagtacttctcaggggagttgtaaagcctggtacctagtagataattagtaaatatcagtttcttttgtctttagagctcacacttcattccatagttttttgttgttgttttgttttgtttttttgagacggaggctcactctgtcgcccaggctggagtgcagtcgtgatcttggctcattgcaacctctgcctcctgggttcaagcgattctcctgcctcagcctcccgagtagctggaactataggcactcaccaccatgcccagctaatttttgtatttttagtagagatggggtttcatcatattggccaggatggtcttgatctcttgacctcgtgatccacccaccttggcctcccaaagtgctgggattataggagtgagccactgtgcctggcctcattccatagtattatagaaaatgtcgaactgtttaagcattccagcactttattttttaattgttattatttttctaccctcagcatgcatcagaggagcattccagccctttagtttggattttcttgctatttctgattttaactatgtgtgttcttcatatcttggactaaaaaataaaaacaaattaaaaatagcaaaaaaaaaaatttgcagtaattttaacagaccaacattaagtactctggaagccagaccagaagctaggggctcgttaatttttatgtatcatcaatggaaatgacttttatttgttaattattttttatgaccacctattgtaacatcttccaacacatatttccccctctttcccgtcctccactctttaaccttccttgcccattttttgtagagatgccagtgaggtctttctcagtcagtgcttcaatcccattatttcccatctcaacaggcttcactggctcaccattatctttcatattagtcacaggctcctcagcctgaattgaggcctttatgacacaattctagtctacctttggagatgtgcttcctttcagtgtcctctctgtatttcatacttactgctttgatcagacaagatggcctgtctttttccaaatggatctcacaatttccaggctctgtgtatttgcttatgttgtatcctctacctagaagtcttttctcctggtccatctgtcctcattaaaaactccactcctgttttcaaattccttgtctgtttcatcgtgactcttctaattgattctctttcactcccacactacttctattgatgttgatttctctgaagctggctcctagtgccttttttcttcttaaggcatgatagtgtgtctcaagttggaatgatttcatggctcccatatggttgattggttgtgggactttatcgctaatgataattcagaaaatagtagtaggactaattgcaattctgcagatttcaccttaaacatatgctgcttcttgggctgtggaagttggacacattgagataagattattcagaaaaacagcaaggccgggcgcagtggctccctcccataatctcagcactttgggaggcctaggtgagagggtcgcttgagcccaggagtttgagagtagcctgggcattataggggtaccctgtctctacagaaaataaaaaaaaaaaattagccttggtggtgtgtgcctgtagtcccagctactcagatggccggggtagaaatcacttgagctcagaagacacaggttgcagtgagctgagattgcaccactgcacttcagcctgggtgacagagcgagcccctgtctcaaaaaaaaaaagaaaagaaaagaaaaaaatattagtaggtctaactgtaattttctaacttctggttttaaatatacactgtttcttgggcagtgacagtagggtaaaattacccagtttgtgtaaatcttatgaggcttgataaatggacttaataattatcagatgacgaaattaaatgagtcggtgaatgttaatgcgtccctccttccatgtaactagatgccttgggacagttccaatatgtggcatttatattgtattatgatgtgttaataatgtggatcagagacaagcaaaagtcaaggataaatgtaatttcctgtgaaatgtatatttaatactttttaacatttagcggaattacctttggatgtcaattgaacattacatccccttactaccgtgactgtgtgtgtgtgtgtgtgtgtgtgtgtgttgggggggtggtgtctaaggagtaaatctattctcttactgcaatttcaaacactgaagtattataaactttctttaattgtatcgagttttatatattttgttgattctaagagtttttgtgtatgtgtgtgatatcagtgaatcaggcaaatttcccagtgtgtgaagcttttgggtcagctattaggttattacatcatttcagaaatgctccgtctgccttctggtggccttcagatttggccaagtagtggagtagtgcaaagactgctaatattgtagaaatcccgtgaccatacgcagtggtttttattttgttctaaggggtacacacttccatttgtctgttttcatgcggagcacatttatatgagggtaagttcaatggcaacttttagtctgtagagggatacgttgagaaatatgttactgaccataaattaccaatttgagatgaatgcatacttcagaggccccactagctcacatttttactgctgtcccctaaaagcaccttcaggtttatatgctgaagatggagaccttcatagttagaaaattgcattccctcaggccacaggaaatattgcttgacattctgtaacactatttgatgttcttaaaacagcatgctatgtagatactactctaggtcatgtctaattttttaatctgtatttataaatactatgaagcttgtggtttttaagaatagtaatgtttacatttatataatttgatgcaatgacttttccctgtaatataaaattaatttaatgtttagtataaaggaaataaccaggttgtatagttgtaggttgtgcaactacaggttgtgtagttgcaggttgtgtagttgacttgtgtattttcacttcctcatactgacaacataaccagaggcctgaccaatgctggtgaaataaccaaaaaggttgtcaggcagacctttgcgttttaatgcaaattcaacagggaatggggtgggcatagcttttttttttttttctgtattatatcaagtaagctgaatatatgcaaggttagagtttaaatgtaatgattagttttattcatatacatttaaaatctaatattctacaagatgcttagcaccatacttgacacattgtgagcattcagtaaactgatgttatcctttaagaagcatttaccacagaggttaagagcatatgctctagagcaaagttgcctaaactatttctgcctctgtttcatcatttctaatatagggatagatcatttagttcatagaacactgttaaatccatataaagcatctataacagtgtttttaataagtaaaaaaaagtcagctaaatattagttgtttattaattgtaatatatcctaaagcaacttatttcttaacgtagacttctgcacattcttggaaaattaatatctctttttttccttgcaatttttttggatatttgaaactataagtatcttcacccagttgtaggacatatgtttttctattttcttcccccttgttggagaaatctatttctacgggacaagctggttatttgtctacagatcctcccctggggattctgtagcagctacttcaaagctatctcagcttgcacttaatcatttgaaacatcagataacttgcttgttcattttatgcatgttttcttattgaggaaattagtcaacctaaaatgagcaccagaagattatttttcttggttttactcttaaagtcattctcaagcatgttatcttggaagagcagggcactctcctgcagcttttaaggatgactgaactggagaacattctgtttaaccacaaaactcatgttccctctgtttaatttcttaaagcttgccctcccttcaatgcaattaccatttttcttacacattaagaggacaaaatttgttggcttcctctttgggggaggatgtttatttatttagaagatactttttgagttcctactggtccaccgggaactatcgtaagtaagttgaggatacagggatgagcaaaatggacaaattctttgttctcatggaccccacaggagaagaaagacaatagctagtaagcaagtaatacatttttttagacagctaatttttgtatttttagtagagatggggttttgccatgttggccgggctggtctggaactcctgacctcaagtgatccgcccacctcagcctcccaaagtgccgggattacaggcatgagccacttcgcctggccaacaagtaaatatttttgactatgtggaaatatgatgaagaaaatgatgaataggaaaatgggactaagaggcaagaagggcgaagcatctatgaggaagtggtatgtggacagagatttgaatgctgacagggaggcagctaagagactctctgaacaaagaagtatccaggcagaaggaacagcatgggccagggctctggggccaaaacaagctcagtctggctgagaaagggaataaatgactgaacacatttctgtagccttctatgttccaggtgctatccaaggtgcttgggatacgtcagccaacatatttgcaatgttttgcatagttgtcctctccaaaactcatgtcgaaatttaatccccagtgtagcagaattgagaattggggcctttaagaggtgattagaccctgagggatctgccctcaagaatggattcatccactcatggattaatggattaatgactaatggactaatgagttgtcatgaaagtgggactggtggctttataagaagaggaaaacagacctgagctaggacactcagtcatgtgacagcctgtgccaccttgggaccctgctgagagtccccaccagcaagaaggccctcaccagatgtggcttctttattttggacttctcagccttcataactgtaagaaataaatttcttttctttatgaattacccagtttcagtttattttgttaacagcaacaggctaagacaataatgcatgattttttctaagtaaattatgtacaatattaactgatcagtgttttaaaaaaatgtttgtatgcagggaggtaagagtgcaggaataggtgggctacagtgtaaaacactgaggtcaaggtaggtctcatagagcaggtggcatttaaacaaagtattgaaggagacggggcaagtttgtcagatgggtatgtgggagaaggaattaccaggcacaggtaatagctagtacaaaagccgtaaggtagcagtaggcccagcttgttccaagtgcctcaagaaagcctctgtaactggaacagagtgagtgagatgagtgaggcggagaagaggttagagaagtgataagaggtggcatcaggccagtctttgtaaaccactgtcaggacttccgtttgattgaaacgaggtgccgtctggtaggtagctttggggtctagactggggaggggtggagcaaagttaggagcagggtgacttgttagcagaataatggaataagccatgagccacactctggttgctcttacagggccgtggtagagatgatgggactttgtcagattctgaatatatttagaaggcttcagaagtgaagtatgagagaaagaagaatccaggatgtgactccaagtgttttgtcctgaaaaaatagaagattgagatgggaaagactagtgctggaacaggattggatgaggtgaggagtggctgtgtaaagcaggagacacccaccgttcccagggcgtagttctgtatctgccttcctgagttaggcttggcagtacgactggctctggccggtgggtcatgtcgatgtgagacaaaagcagggtacggaaatgtactcccagatcgggctcagcctcttgtgatgcagtcattttcatgagaagagctttcctggggcagacgttgccctcttagcctggaccccaagtgaatgcaagtgacacagagccaccccagctaagcccagctcatcccacatttggaaggagggctgcccatggagcctgctttagattaccagaccctacagaatcaagagaattaatagctactgttgtaagccaatgagtttggaggtggtctgttatgcagaagttttgtggcaatagctcagtaatagagaatccagggagtgaagtgaaatagggagttggatataggagtctggagttgagaagaagtcttggttggagacaaaaatgtaagcgtcattggcataccaatggtatttaaaacctcaaggcaaatgagatcaccatgggagtgaatgtagtagagagggtgaccgaagattgcatgactacatcattacaatgtctggaagaagaggagcaacccatgaggaggaaggaaaatgccctacaaatgaaatggatgaaaacaatatctaggaggaggaagtgacaaatgatgtcaaaggcaactgccaagaattggtcattggatgtggtaacctggggagaattgttgactttgataaatacagttttatgggagtgttggaggtgcaagcctgattagagtgattttaaacacgaatataggcggagagcaactggagatagagagcaaagtaactttttgaggagtttgtgggaaggagacagaaatgaaatgaaacaatggcctcctcacaaaaggagcgcgaaaccatggtaagggtgtactttattctgagcggggaggtagttgaagcgtttaaataatgacctatttgtcttttagatattgctctgactgctgtatagagaatggcgtggggtgaaagggagcagaacagttataaggctatttctgtttcctaggtgagagagtgtgttggcttcagctgtagccctggaaatgtggaaagtcatgtgtaaatttcacatggggtaatggtattaggtagacagcagtgtgggatctttagcttaaggaacttaaaaaagtgtttgtgatcaaatgaaaaatcacaaatgtatatgagaattatgttttgtaacttctctttagctctaccttatcttatataaatcatactggtttgaagcaatatatattggttactttattaaaatttacattctgttatttttttaaataattcctgttgtctatgataaaatggatatgactggccaggcatggtgtctgacgcctgtaatcccagcaatttaggaggccaaggcaggaggatcacttgaggtcaagagttcgagaccagcatggccaacatggtgaaaccccgtctctacaaaaaatacaaacattaaccggatgtggtggtgggcgcctgtaatccccagctactcatgaagctgaggcaggagaattgcttgaacccaggaggtggagattgcagtgagccagtcgtgcctgcactccagcctgggtgacaaagtgacactgtctcaaaaaaaaaaaaaataaaagtggatatggtaatttttctcctttccaaattatattttgttccatcctggatcattcagtctacactggcgtatttcgctcaagtgacattagagatggtttctggcataatatccttgtctgagtctgtgtgcaaaataacttttttaaaaagtggaataagttctatgatctgtagttgggatagggattaaacaacaacagcaaaacagacttttacttccttagatctcagatttatatgtatagagaattggttttacacaaatagtgaataaagtattttgccaagtgtgctttcagtagagacttgaatgattgtgatctgttttgctcttattccacgttcagaggttcccatgggaaccactcccaattcgtgggaagagtggaatttaacaaacaatacagaaaagccatttaatcatcctctgtgtgatccacaaaagtgccagaaatacggaggaaatgaaatcactagaatctctatctgtatgggcctgcccagagaaaaaagtgctgctcatggtaaatagatttgatagatggcagaaaaacaccagtgtcctaaatctgacagtaacaaaaaacctctcccatcatccatctccttcagataccttttcaaaatttgttaagtgttttgtgtcctagagtttggcatcttgccattttaatttaactatttttcccctgaaagatttgtttccagaaaaagcttgggatcataatacagtaaaccttacacataatcttctcattatgttcagaaagctaattttaaacctaattttcccatctctgtctctctctattccagtgcttacctgcctgcattaattaattcctgtgcagcaatgaaaatttgactcagttacctgacctcttaccttctgattgcagaggctctgtctcttacaggggtgtgggacgcctggtgccacaggacatgtgaacacagattatccgtacctgggaggtgactttggtgagatcggagacattggagtcccccaggagcagctcctcagcagattggggataagaacagagggcacctacaacaatctatgtattacagaacacagctctttttcttttgcgaacacagctgtttttcttttgcctgacttgactgaaaactgtttttaagtgaattaagtgttttaagtgaattaggtgtttcagctatgtcgccagtgggcactgaatcctaaaacagtgatctggaagggtcttggtgaccatgctatccaagcaccatgagatttggacctccaagttgggttcatcttctcactctccccgtgctctctactgtgaaaccacattggtcttcgcttcctccaacacagctagctcttgtctgcaccagagtctttgaactgtggtgcgttttacgtgaaatacctccaaatgattcttgttcatccttaagatctcagaatagatgtcatttcctcagaaagcaccaccttcttgaccctccagcctacaggaggattccctggactgtgttgtcatagcacctttgcttttccatcaaaatatttaacatagttcataaattgtttcatagatgagggggtggttagctcgggttgctttttctcttctccagtaagagatttcagaatcactccccttagaatcatttatatgaggttttcccctgagggcaggccagtggcctcactgcttcagaagggggtgtaatcagggtgaagagcaaaaatgcttggtatctttgagggaaaagaaatgaagttttggagagctggtaggtgccagagccgttcctgcctcagtgcttccataaccagctggggacttaggaggtggctgtttgtgggattcaaaaaacggaaccatgggaaccttggaagcccaagtgctgggcgtcttcgatgagcttagcattcagaagagaaattgcgcttcataggccatgtggggtctgtgcataaacctgtatacagcagagttcattgcagcaatggtcccgcgccttcctcagcagcgtcctcaagcagcgccaccgtgtggcagcagtaagcaatggcagtgatcggattcctgtccactccctggtgtggatgtcctcggcggacttcctgtccattacgcatgtgggacatcaagagataaatcggaaaaataagaaatacaactgtatatgaagcccggtttggagaggcatttgtttgcataagtctgtaagatccgttgtagaccctcggtaaatgtttgttttggagatgaggaaatggaggcagagagaaggcaagtcatttatcacagacagcgttaactctgggcagagttaggataagaatatgtgaatcttctggccccagttttggtagttctgcagttgaaagataccatgaagaaggatgatgtgtattaagagaccatgatccgatcactctttatgagattactaagagctatggattgctagggctattcctggctatttggggagagggaagtctgaccctcttggatgcttattttatctctggcaaccattttggggtcattaatatttctcatctgcatgtctgtacctcttccttccagttttcctaatgaccttcttcctttttgcctgcctccttgcatttccgtttcgttggtttaccaaatagatttcattgtgagatatgtgtgtcattgagtcaaatgtatcttcactaaaagagaagttctggttcctgttctgaaatttctgtcttacacatttaaaaatggaagaagatatttaaaagtaaaataaattaaataagcacacattaatataatgagattacataagacctggtggataatatgtgagactgggttgagattgatgagtgatggcttcttagaggagaaagattttaaagatatgcgatatgaaagtagagggaggaggtgtgcactccgacgagaaatgagacaggtggggaagtccagtgtacatgtgtttacggggttagtgagaagagagttggcaaaagtgtatgggattattcagaacaatctgaggaaaagatatctggcttagggaaggagttcctggagtcaatggagacttaagctgttaaaggaaaataaaagtgaaaaaaatgaaaaaaactttggagtagtttttgggctcaaaatctcactttactgttactatctgggtgactttggacaaggtatttaagatatgaatgtgttttctcatctacaaaaatgtgcttttgtgaaaatcaagtaaaatgtcctatgagatgccctaaaacaatactggcctagaggaggtgttcaataaatgtaacttttacactttataccaatttcaaattctcatcactaagttatagtttcaaatgaatgttttcagtttatcttgatgttgctcctgacttcaaaattttctgtttggattttcttagaaattaataatctttcacacatagctatcaaataaatcattgttttcatttaagaaacatggataaattggcacacacacaaaatcattctcagaaatctatcaaaaccaattaaaggaaccccaaattaggaaggacaattgcatttgtcatgaaattagagtggagcctcagcctcaaaccctaaattacaaagactagtttttgaattcaatttaatagaagcttccaggatttcatacatatgttctttaattttgcatatactgcatatatgggaaatgagaatgcttgaaggggcttttaaaccctggtaattaggacagggtggcaaagtgacacatcaaagtttatgttccagaaataaaaaagaaacttgtgacaaatgacttacaaagggcgaattttttccccaaaagtattaatgtaagaagtttagatatgtttctaaaagtctaccatccctcattatttgtccatcattatttcagtacaaacatacccaatgtttcataaaatatatttcattaataattaagacagacaagctttgatttaacaatttcttaccatatgaatgtggttgtggtctcaaccactggtaaaagaattatgggggacacattcagctgctgcaataaagacaaccattgtaaatgcttacctcttagatgaaaatggttgggccggatgtcctcctattgtttgctcttccacatctgaaaagaacgtagactaaatggagtgaatcctcactgatacatggaagtgaatatgtccacattggcagcattcataaacagcagcaggtttccttaatatgagaatcagagtagttacagcatagatgagtttttgagcctgcatagaaaaagtccagaaaacatgcagcacgcactgctggtgagcattaactcactcttgtcatttgggaaagagaacccattgtttctagatcttcaatttctgcagaaaagcatggagtctgttactcttcatttttttgttttgtttgttttgtttttggaagagtgaaatctccagctttaaaaatgttggcaacaaatacaacattctttttaaagcatagtcagtgtaagcatcgttggtgggctagacaggacatacctgtgagccagatttgactcacaggctttcagtttgcagtctctgaggtctagtgtatgaagttggaatcccgagaggcagcgagtgggagaaaatgaaggctcagaacaagtcagacctcttgtagcaggcctataacttcttcctggagcaccttgactctcttagcaccatacaggatctgatctgagagagagttgtgtaagattgatgctccagaattatactgtatacttttgaccagaatattttcattttcagtatgaacacattgctctcttaagtattttttgcatttgtaaaagaaaataataagccccaacatatccctgaagcttacaatatctgtgccccaaactcttccttatgaactttcttaatattttaacaatatcaaaacagaaaaaaaattgttaggcataaattatctacttactctgacctatatcgggttctttttcaagcttttcaaaaggtgacacaaaagccagttcaacctgaatattggaaaagaattgcaggggtctctgagcattgggaaaggatacaaaaggcatcagaagtttggctttgagacagttgccatgaaaggtatctcattttcctgccctggagattttatattaaatggattatctgtctgtcaagcattttgagcattccccttcactgctttccctgaggactattgcagcatcttaccgtgtgaggtgggccatatttttttttgcagatgatttatagaatatgagatatataagcagccgttaacacatctagttttatttttaaagttatgtttgaatggattatgtttgtcccacaatcattttttaatctgaataataaggtcaatttgacacagctctttttttttttttaacatttagtttaatcctttaacaaaccttgccctcatttctgtttaaccttggaccacctgctttggctggttatgtaatttgcaaattagaaaatgactatttcttttttcttgttattggactccaaaactcacccaaattctttttctttgctttgtgtttcctctctgtcttcctaatttcttatgcctgtattaataaaatggcttgagagataatagtctagttaaatgcatagtttcctaatttgcttatggaaaagctaaagtagactggaaagaacatgttactaaattataattttaaattttttatcattgaatgtcagtctcactgtgatccttttatgactctataaatatgctttcttttgaatgctggaggtggaaggcaggttggcggtcacctggactaaaaccatcgttttactgaaaaagcaattgtgaactaaataggagaggtctcttggccaaggtcaaacataagctggtggcaaaatcaggagagagtcttgtatcctggttaagaggtataaggatccagagtcagacaaaactccatgtcctggatggccttatattagttatcttgctatgacttctggcaagtcaaataacttttctgagcctcagtttcaaaaattttaaaatgaagattatcatattgctcactgttatttataatgtggaataagtgatagattccacatcaactgcgtgacatctaacacctagtaagctctcagtaagttgttactgttattgctgcatctctcataatcatcactctgatcacctgtctatgtttgtgtcatcacacagctctagcaatgtttccaaaccaaagaaagggtcccttaaacttcctcagcaagggcttggcatctgttgtcatttgttgactgtttctcagatggttcaggaatgtatacggtgcgtattattaagtttgcagctccccttgatttccattcgtcacatttggtccataaattcaatcaatatgtattgaacaccttccttctgtacacaaagctctactagatccctaggatacagggtgaacaagaaggtataatccctcttgcctggggcttatgtttggagttgggagaatagaagctaaataactaatcatactgttgtttacttatggttgtgttcagtggttaaagttgagtaccaagtgctatgagtgagtaaaagaggggagtcaaagatggaggcttctcggacaagtaggtcttagctaggcatgacctaaggtataattatttttattttgaagggatggtatctgaggaggtacaggaagcagaagtcattgaaattttagggatgaatagaaagtcattgtggctgaagcaaggggatgctggaggataagggtggaaaggaaggaggggctgaaacattaatttttaggccatgttaagttttctgggctgcattataagaaaataaatggaatgttattgaaaggttatacacagaaaaatatcatcaccagatcttttataaagataattttagtgcttcatgaagaacaagtagaggaagcagagagaactgcttggggtcggggtggcttgtaatagagtgggggcagtggaggtggagagagatctgagaaatacaaagaggtacaaggaaccagcctggtgtgtgactggtgtgtcagtggaggcagagagagatgtcaagaatgactccacttttgacatgaactccagtcatcatgaatgttggagtaagactggtccatgatcatatttttttcctggtgaaataaagcacggaggagttctgagttctggaaaaagaccgattgaaatgagaggtgaaaagagaacgctaagtacgatgaggacagaagacatactttaaatatgttaagtagtaagaacatcaaatactaggagccagtatagttaagttacgaattgtgaggtttgtgtatgttagagttgaggaattcctgtttcttgctgttttgatgggcacagtgttcttccacgacagtaatcagataaactacttaggtcaactcaattaatctcttttaaaagaagcctggaataatctgctccgttctttgacataaattgattgattagaatgtttgcatccccaaattaaggtaaaaccactgccattttacagaaggtattgatcttatgtctgttaaaattgtatctttaaattttttaatttagttttattctttttcaatgagaatacagatttcaaactaaatgtagtgtaggtgtgaatgataataaaataccacataatttagtgtagttttcctatacgcattatattcatttcagcgcattatgatttcaactgtgtttgtacttgaattactcatttttgtttatcaacatgaggtttccatctgatccagaatcaaatagtttttattcagagttctattcatttactaaaaataatttcttatgaatgttctcatatatgcacatgcatgcatgttttaaaaagataacagaatcctgttattgccaagaaatttgggggtaagaccatggtggcaatttaagcaggttttgttttgttttagttttgtttttgagatctttatttctcccagctacctatcaaataatataggagggaaaactgtgtcccacaactggaaaacccataaggctccccagtcatctacctcaaatcttgaggagtctccagagctatcattgtgcaaagagatgtgggggagctgttctgacctgtttattgactcaatagtatgtgtcattcaaatttagggaatggagaaagatgctgttgccattctgctggccatgttacttgtcaaagcccataaccacgaatgtttggagaaaatttaaagttgaatataggagagaacaataatgatatggaagtttcctgtactactcaggaggatatcacatttatcaaataaaagaaacaataagaaaacagggctgggtgtggtggctcaggcctgtagtcccagcactttgggaggcagaggcgggtgggtggcttgagtccaggagtttgtgaccagcctgggcaacatagggagaccccatctctacaaaatatataaaaattagctgggtgtggtagtgcacacgtgtagtcacagctactctggaggctgaggtggaaggctagcttgaagccaggaggctgaagttgcagtgagcgaaggtcatgccactgcaccccagcctgagcagcaaaacaagaccctgtctcaaattatactacaaggctatagttaccaaatcagcatggtactggtataaaaatagccaagtaaaccagtggaacagaatagggaacccagaaataaagccaaatactcatagccaactgatcttcaacaaagcatacaaaagcataaagtgaggaaaagacaccttattcaataaatggtgcagggaaaactggcaagccacatgtagaagaatgaagctgtgtcctcatctctcaccttatacaaaaatcaactcaagattcatcaaagacttaaatctaagacatgaaaccatagaaattctagaagatacatcagaaaaactcttgtagatattggcttagggaaagaattcatgactaaggacccaaaagcaaatgtaagaaaaaccaaaataaataaatgagacctaattaaactaaaaagcttctgcacagcaaaagaaatagtcagcaagtaaatagacaacccgcagaatgggagaaaatatttgcaaactatgcatctgacaaaggactaaaatatcgagaatctgcaaggaactcaagaaaaaaaaaactaataatcccatcaaaaagtgggcaaaggacatgaatagacaattcacaaatggagatacacaaacagccaataaacatatgaaaaaatgcttcacatcactagttatcagggaaatgcaaaataaaaccataacgagatataatctcacacaagtcaaaatgactgttattaaaaagtcaaaaaataatagatattggcctgaaagtggtgaaaaggtaacacttttacactgctggtgagaatgtaaactagtacaaccactgtggaaaacagtatggagattccttaaggaactaaaagagagagctaagctgtgaggctgcaaaggtataacaatgataaaatggactttggggattcaggggaaagggtaggaggtggatgggggataaaagactacatgttgggtacaatgtacactgcttgggtgatgagtgcaccaaaatcccagaaatcaccactaaagaactatctgtgtaacaagaaaccacctgtacccccacaactattgaaataaaaaagaaaaaaaggaaagcaaaattaaaacaaagaagaaagagagattgcttgaggaaaaaaaaaacaacaacaaagtataccctttagtagagatagtaaatatcagaatggatgctactgaccaaattaattaactggaaggctgagaaaattcgcataactgtaagtaaaaaagaggttttataagagagaggatgacgcacataggataggtcttggggctcatctcataactaataataggaattttagaaatagagaacagatgagaggaaggaggagaactaacagattaccatttcctctaagccaaacctaattcttcaagccttcacattgaatgacctcactacaagctggtgaagattaatgaaaataaaaacttttagacataccatgatggaattttgaattccaaggtaaagagaaaatgtatacaaaagttgacacagaaaaacaattagttaccttcaaggaaaagagaatttgactattatccagtttctcatctgccacagaaaatgctagtggacaatgcaacattcctttcagaactgtgagtaaaaagggttgcaatcatagtattctctcaccagacacagtttgctcatgtttgacggaaaaatgtgcgttttgatacatgaaaggactcaaagtattctgcaaatgtactgtttaaaaaaaacaaaacaaaacaaaaggaggtagtaggaggagacttaaggatgtactatagccaaaatgaaaatgagtcaaaatatatcacaaataggtcacaatatgagaaggggtgcaagatatatgggtcacaaatgctgctacaagactggccctgggcagattgcattaatatcacctaaggtggccaggcctggtggctcccgcctgtaatcgcagcactttgggaggctgaagcaggtggatcatctgaggtcaggaggtcgagaccagcctggccaacatggtgaaaccccatctctactaaaaatacaaaaattagctgggtgtgatggcgggctcctgtaatcccagctactccagaggctgaggcaggagaattgcttgaacccaggaggcagaggttgcagtgagctgagatcgcgccattgcactccagcctgggtgacaagagcaagactgcatcttaaaaaaaaaaaaagacaaaacaaaaaccacctaatgagattttctttccccagctttattgaagaataattgaaaaataaaaattgtttacattcaaggtatacaacttgattattttgacatgtgtgtacattgtgacaagattaccacaatcaagttagttaacatcttcatcacctcacatagttacctttttttgttgtggtgagaatacttaagacgtactctctttgtaaatttcaagtatacaatacattattactaactatattcaccatgctgtacattaggtatccagaaatcattcattcattaggtatccagaaattattcaaagtttgtgccctttgaccaaaacctccctgttacccccacacctgccccctggtaaccaccattctattttctgtttctatgggttcaactcttttggattccacatataagtgagatcacgcagtatttttctttctgtgcctggcttacttcactttgcataataatgtcctctaggctcattgatgttgcaactggcagaattttttttaagactgaaaaatgttcagctgtgtggaatattatattactattaatattatatgctatattttatatataccacaattgtgatgggtgtaccacaatttcttcaatatcagggctattttgaataatgctgtaatgaacgtggaagttcatctgtctcttcgagagagctattttatttcttttggatatatacccagaagtggaattgctgggtcatatgactgttctatttttaactttttgaggaatctttactgttttgcataatggtatattcattataatgcataatgtcaatttatatccccatcaacagtgtttaagggcttcgttttcaccacatccttgctcaacattagtattcatcagggaaacgcaaatcaaaaccacaatgaaatctcatctcacacctgttaggattttttttggttattatctattatttttgataataattattatcaaaaagtgaaaagataacaagcaagggaattctgccaaggagactttaaatgctgattcctggagtccaaagtgagagattatgagagtgtaaacctgagataggtcccagtagtctgtatttttaataagttctccaagtcacctgacagccaaatttggtaacctgagagtaatgagttcagtaaaatatattacaattaaattattattgataatgtaagttatgaaatattaatgaaatggttaagaaaggatcctcaactgcaaggacaaaaatgcaatcatttttgtctgaaagtaaattctagcttatttcaagagaatctaggtgctgtgtgtatgttgtgaatgctgtgtagtgtaagggaatcactgaagacttagaagcttgtaaatgcctagccttgttcctgaagggggagctcttagagaccgtttagtcattgagattgatggagaaacattacttacatatgcttatatatttaaagattaccaacagtgaaatacaaataagatgaatagctccttaatggctagagaatgcaaaataacacataagaaaaagaaagcttcgatagtagagtaaaaatttggaagaaagaaacgagaaaatataaacaaacaactatgagtgatagaatgtagtttgatagtagtaatcatttcactatgtatatgtatatcaaaatattatgttgtgtacatcagacatagatgtaataaaaataaatttaaaaatatatatgcaagttacaattaaagtaggtaaattaaatcttaaattacaaaacatttttgcattagcttaagaaggataaaccaattccatgctgtttaaaagaagactttttttttaaatggcacaaagtaattggaaagtttttcactattatatctgcagctcttggcatgattggacatatggttcaaaaatgattgccacctcatggaatgaatggatgtggaaaagtataacagcctcctatcacaaccacaaccaaaaataaaaaggtaacgtgtaacaataccattattacaatacacttcaaataataaataattagatggcacatagggctatttttaccaaaaaatccaccattaaacaaggtataatagcatcaaacttttgtgcactgaaggacacacattatgatgaattggaaacataaacattcaagaagaaattaacaaaactattaccagactgggaaattttaatacatctctcagaattggactagtcaaaaaaatccaagacaaatgatgtaatattttccacaatattaagctcataccaatgctttgataaccataagctttttaccttgtcatttaataacattttaattgtaaaataaagtaaatatgatgactaaaagtaaatgaaaacattcgaacaaaatacttctttgttttcaccctggcccattttaatatgtccacttggcttctaatagtatatgatgtttccctttcctcgtttgagaacccctggtttgaatattacagttcagttaagatttatttcaagaccaggcatggtggcttatgcctgtaatccctgaagcagaaggatcacttgaggctaggcgttcaacagaccaagcaacataggaagactccatctctacaaaaaattttaaaacattagctgggcatggtgttgtgtgcctatggttctagctaggctgagccaggaggatcgcttgagtccaggagttaaaggttatagtaagctatgatgaggccattgcaccccactctgacctgggtgacagagtaagaccttgcctccatggttggaaagttatactctacaaatgtagactgtatattgtttcaaaaatgtttttggaatgtttatgaaatttgatcatatatgtaaagaaaatttcaaatattaaatattaaaaatcttataggttatattgtctaattaaagagcaataaaattataaattagcaaggaccaaaaatatgagctacttggaaattaaaattaaacttgtgaatggcttttgggtttaagtggaaatcaattatactatgaactatctttaaaacaagtcacagaaaataattattcaggattctaatatgtggtcagatgtttactgagagagatttttaaaaatgtaaatgcatcattcttaaatatgaaagattgaaattaagtaatctaaacatttaactcgagaggctagaaaatgacattataaaacaaaataaattaataaaaagtgaatagttatttaaaagtagaaattaatgacttgtttacatataaaatatatagaattaaaaataccccatatttgaaaagacttgtaaaatcaacaaagctttgttgtttctgattcaaaaaaatgagttcataaatgtatgatattaaatttaaaggagataggaccatttgtatgtaatacattttcaaaatcagtagtgcttgttatggatgtaatacttgcaagcagatttggtgatttgcttggaaaaagaaagaaccactttgttttttcgaaaagaaaaatttcctgcttaaatgaattgccaagataaagcaaattaaagattgtcttagatttaccctcagttctgcaaaatacacagattcagatggcttcctagttaagtgctgaagctcaagagacaaatcattaccaagtgatttaaaatgtttcagaattttaaaactaaaagtaatagggaacactttctatcttatttaaagttcatgttttgagagtctaatatatattgtgaaattttagaaaggctgtacgaagtaacattaaaaattgtagaccagcttccttattattactcttgtaaatatgattgaatcgcaggcatcatcaagttaaaagaatgatatacacttaccaagtatatttgttctaaaaatgcaagaagagttcagtattcagaggtatattaatataattatttataatacattgaaaagataaattccacatctctattttgaaagatgtttaacgccttttgatgaaatcaaatcgacattccccagtaacatttttagaacattaggaatgataaaataaactttttttttttgagacggagtctggctctgtcactcaggctggagtgcggtggcgcgatctcggctcactgcaagctccgcctcccgggttcccgccattctcctgcctcagcctcccgagtagctgggactacaggcgccgccaccacgcccggctgatttttttgtagagacggggtttcaccctgctagccaggatggtctcgatctcctgacctcgtgatccacccgcctccgcctcccaaagtgctgggattacaggcgtgagccaccgcgcccggcctagaaactttaaagctattatgaaagatatgaaaaacagtagtgaatataacaattcactgtaaacagtaaaactgtttctgttttaagttaaagaacaaatactctttatcaatgctcttagtcaacaatgctctgaagattatagttggtaaaatgaaaacagaattaagaataaataatgggaaaggacaaatattactattttcagattgtatatgggttcttcaataaatttttacaattaaaagcttttagaactaatgagttcactacatgatgagagataagataaatgaaactagttattagctaatacttgcaagaatcaaaaaagtaagggaggccgggcgcggtggctcacgcctgtaatcccagcactttgggaggccgaggcgggaggatcacaaggtcaggagatcgagaccatcctggctaacacggtgaaaccccgtctctactaaaaatacaaaaaattagccgggcgtggtggcggcgcctgtagtcccagctactcgggaggctgaggcgggagaatggcgggaacccgggaggcggagcttgcagtgagccgagatcgcgccaccgcactccagcctgggcgacacaccaagactccgtctcaaaacaaaaaaacaacaacaacaaaaagaggaataatattatattcacagaagaaagaaatacaaaaaaattagaagtaaacttaggaaacttaggaaatcatcaagacctacatgaaaaaatagtaccattcactatatgatataaacaagtgcttgattgaaaagtaaacacactctcctcctaaatgggaagtcctgtcattctaaggatgtcacatgtgcccacattaatctgtaagtttactgaagttcaagtaaaaatctttacagtttttctgtttttgttttttgcttagaataaaggcagaacttaatgaacctaaatttgatttggagaaaaaagtgggtagagaaatgtagggagtgaacagagccttttggaagagggaatgggagactttactagatataaatatgaatgtaaaagccaaaatattttaaaatgtactgtcagtaaaaacttatgcagatgtagatggatcaatagaaatagaacaaaccgtagttataaatttaagtggatattaaatgtcatataaaatgaattgtaatatggattgataactcagcaaatactgaaaaaatggtctattttaatacttagatcaataccacttcaaacaaaagcacattactctgaaacttaaatatagaaataatcacatactactatacgaaaatacagaatgtttctaacttttaagcaaggacttcctcagcctgattttagtcgaataactataatagaggaagatgtttctttaaaaaactaaattctgtaaaacacgaattctttataaacacaaagtcatatataaacaaatgtttattgcagtattttttattacatccaaaaaccatgcacctaaatgtccaccaggaaatggacagataaataaaaatgatttgctcttaccaaaaatgttaaaataactttaaataatgataaggtgggtctacatgtatggacctggaaaaatgccattacattttcagaggacaaaaacactcataaaataggatgtaatatgtgatctcatttttataattccacgtctttgcatttttgtctgtcttttgtgtgtagaaaaagaaaataatgtgaaactaataccaacttcaagaattaaggggatgaaattacacagtggagatttttaactttatttttatatattctgaaatatttgaatggtgaacagtcattgctttaataattggaaaaagtagagctatttccaatttgggttaaaaaagtcagtgggacattatcgtctatattctacctgtatgattgagatcctaagccaaaccaattcttagagatattctgaatgacatatcccaaagcgcaggtaagtacactcactgttagactctgctcatagttatgagggaaacatagtctccagtcacatcaaaaaccatgaaagacaagaaaagatcattagtatactgtatttacttgagttacttactgaatagtatgtactgggctcttggtgtgtttggtattaatattgactgttgggttctagtctagactcttggttctgtggtgctgtcatctataccattggtccttggaacaggagcacctaggaacttgttagaaacagaaagtctcagacttcattcctgacctcgtgaatcagaaatttctggagcccacgctcaatcagcaagcactccaggtgattctgatggatccgaatgtttgagaaccactgctctgctgcatccaggggaaagctatttactaagtcaagttttattgtaagttgatctttctcttttgagtatatcagaatttattaagaatgattagaaaattgattgcaaaccaaagagtggataaagaaaatggggcatatatacaccatggaatactactcagccataaaaaaaaacgaaataatgtctttttcagcaacttagatggagctggaggccattattctaaatgaagtaactcagaaatggaaaaccaaacattgtatgttctcacttataagtgggagccaagctatgaggatgcaaaggcataagaatgatttaatggactttggggacttgaggggaagggtgaaatgggggtgaggcataaaagactacatattgggtacagtgttcattgcttgggtgatggctgcaacaaaatcccggaaatcaccactgaaggacttatccacgtaaccaaaaaccacctgtaccctaaaaacgattgaaataaaaaacaaaaaaaagaaaactggtggcaagtaggccagcccatgaaagccgtttaatacttggttaagtagactgacattcttttcgtagatggtagggagctttaaagatttctgaatgtgagaaggacatgagtggttgatgtccatcaggacaactgctctagctgcagtgtatagcagattgcaggagactgacagtggagatggagagccaagttagaaggcaattaaataggtcaagcaagaggtagtaaaaacctggattggagtagaggaaatggaattggaaaagagacaaatgagaaagagagattgtgaaagtgagaacagtgcttggtccctgatggcatgtaggggccaaaagagaagaaaggcaaagatgattgacgttttaagcctatgtgacaggtattattggcactacagatcagaacaactatcagtgatctgcaacgtggtagattgtgctgatatcagtcatcacacagaagattggtttgtttggatttctaaattggggcttttcagttcattggaaggatggttaaaaatctcaatgattagcattagaacaaaagagaacagaaatacagttgagtactttgccagactcatcaaatatgattttgatgggctaagaactcctaacgaggacacagtgatcaactgagcaaacagaccatttggcttgaacagaaatgtcaacataggcataatctactaagttgctaattagggatggtactagccggttgatggacttcagccaagacatacagaatggtgagaagccagtgcacagagcctctgggaatctgaatgatcaattatttttcatcccataatgtaatttacctgtattagaatttatatgcagaattaaacactccttcttcagagtttccacagtattctagatttttattgaagtatttattttaatggtttatttatcttgggcagagctttttgtggggatatcaaactgttaatggatagaaagggatagattgaatattcctgagagttggatcagtgtgaagtaaagttgaagttggttatactatggcaagtatgatgtagagaaaatctttcggatgttcgaaggtcaactcagctacttacttccttttataatttggttcgacttgaacactatgattcctcatttgttaaatagaaataataataatagtttacctcatagggttattataagaattaaatctaaaatccagttgacttgaactctaaaagataaaataaaatttgaaaaagaactaaaggaaaaaataattaaataaaattatgcatatgcaatgttaaaaaacagaatcggaaaaataatttctcaaagagggtagctgttgttgctattatcgttgttttattttattgtcaaacaggctgtgagagtcaactagaagggtgacgatcttgaggtaagaagtttttgcatccctctagcatattttacaagcagcatcaggtacaagctaaatgagtgtcgctgagcctgaacttgtttggtgagtagttgaataagggaatgataaggcccacattcatttatttttacttttaaggtagaagggtgcagcaacttggtttctgcagaatgtatcacttgctgtcttttccgtggaaaagaggctatagttgttcattcagattgaacaactgattgtaaaattgtaatacccctagatggaggtgtataagaaaactaagccatttcttttcttataaatatgcatacatgtcttagttcattcatgcttctctaacagcataacatagactgggtggcttataagcaacagacatttatttctcaaaattctggagactgggatttccaaatcaaggagctggcaaattggatgtctggtgagggcccacttctggttcatagccagccttcttctctctgagttctcacagggtgtaaaggaccaaggaactctcctgagtctctttgatgagggcactaatctcattcaaaagggttccaccctcatgatctaatcatctaccaaaggccttacctcctaatagtatctctgataggccagtcttgtgttgccagaaatgaacattctcaagttcatttcatgccagaaaggaatatctgagactgggtaatttattttaaaaagaggtttaattgactcacagttctgcaagtggtataagcatggcattggcatctgctcagcttctggagaggcctcagggagctttcagtcatggcagaaggcaaagcaggagcgggcacatcacatggcaaaagcaggagcaagagagtggggaagtgccacatattttcaaacaactgtatatggacactcattattgtaaggacagcacgaagccatgagggatcctcccccatgatccagtcacttcccaccaggccccatctccaaaactggagtttacaattcaacatgagatttgggtggggtcaaatgttccaactatatcactatcacattggtgattaggatttcagcatttgaatttgcaggggacataaatatttgatctatggaaatatgtataagacatttatttaatctataaaataagatctctaatgaatgtgttataaaaggtagcttctaggttcactgtcctattttaggaaacttgcaaatgttcattagtctcctaaacctctgccgatagcttgccttttctttgtgaccttggattttttttttgtaggattccctgtctagaatatcctagcttgtttttcctaaacatggaaatcactaatccttcatggccgagtttaccatccttctccttagtaatttcgctttatttcaacaaggaaaaaaagtctgagaaattctgtagcactttggtccattgttatgacatgcatttcaaatgacctaacactgtttatatttgtgtagaaattttatttatcttattagattgtaaactccatacaagaaagctgaaaaaataaaattaagaatacggggaaaggtttgaagcagaaggtcagagacagaggcttcttcaatgccatacagaggattgggcttgagtagtaactactgcttgataccagatgacttaatctctctaaccatgatgtaatgaaccagaggtgggtccctgtccccaaaggactgtgatccttaataagtgacttggtaagagctctggctaactggtgtgttgaaaatgtcacaacaccctaacctgatctgatcatacagacagaatgagcagagtgattggactaaagctaaaaggcagagagagggcaatgatattacaggcaagcagctagcacagcaaaaaattcaatgtaaataaaatagtagagttaggagaagattatctgccctctttaccaaccccttcatctttaagttaaatctcatgaactcaagttacctgaaaatatggtttattccatgtatgtgaaaaaaggcctgactagtacagcatcattttgtaatctctttggcagaaatgattctttttatatgttgagtctaaatgcactgccttgtagcttccatgcacaggtacttgtcatgcttcctgaaatcacacagaacatgcattaactatgtagccaatgacaggccttctaggatgagcagattcttcaacagtagggagatgtctttcacaggaaacgaatgagtatttgtcagggcttcacttgatatactttctaccactgtcccggtaaggaatagcagaatataaataaagggtctaatatgtacttattaatgagtttgctaaatagaatatatataccacttagtgagtggtactatgattgttttgggtacatacctaagattagcttttgttttaatagtagaaatatgtatatattattatgtatattaggaaaatataaccagcatggaaaacccatggcttccttgagtctattcattaagacaaatggaaaatacatatttaaatttaaaataagaatttaacaatgctaagtaaacagttctagtggtatgcacatatggccaacataatggaggatgtttgctaatgatggtaattagtataacactgctttaagaaaaagtgtcaacagattagcatgatatgccacaagcaaactggaccaagattatcacttttatttttgctttctaatttcagcggttaaattttaagatatttgatatagcttaggagattgattgctttgaaaaccaacttaaatatgaaataaagaaactatactagcacaagtaatgcaagaaataaacatcacttcaaggtcaatatcaagaaattggaaccctttctgaatttataagaatattttgagaaacaactttcctgtcaaatggaagtcaggagaaaatcaacaaagagtcacctttgtacccaagaaaacctatagacacatgtaacagcatgcagaaatataaaggtaaaaaaatcactcaagagtcagtgagaattttttttagtaaaggtcatttgatgtccacttccttgtatatcaaatagttaaatgcggatgaaagcaggagatatgaataatactagaccgtgtatccattaaggaatcatgaaaacaaaagtttaaagcaagaattgctaaaaccaagtgttttctcaaaagagctcttaagtcaaatgtagaggtaagaatatatgactttatcactgtatcattttattacaggatggaattcaacattttcaatgtgattttcatgtattttattgatttgggaaggttagcgattaaatattgttaataacattctacctggtttctcaacatctcatatcttttttcctctgacccatcagaaatactactggcacacttgtctccccagtgcacttcttggattgtttttgctcctctgctcaccacacttcttgaggctgcttcctgaattcctccatacatatgaattctttagcaggctattcagcatgcctgtgctgtctgtgccaaatctaacttccagtcattttcctttgcacttgtgtttggctacttaggtttatcttaatatgctctatatgccagggctcttcagagaagcagaaccaatgggattgtgtgtgtgtttgtgtgtgtgtgtgtgtgtgtgtgtgtgtgtgtgtgtatctccaggaaacttcagtttttacatttaaggctttcagctgattggatgaagatcacccacattaaggagaataatctcctttacttaagctgaattgattatagatgttaatcctatcaacaaaatactttcaaagcaatatcaagactagtgtttgaccaaacaactgggccccagagcctagccaaggtgacgcataaaatttaaccatcacaattgccttgcttttctttctctatcgtctggattttaaaattttttatactttaccttatatgtccttattccatattcctaaatttgaatacccttcaagccccagctcatttctctcttattttcaaagtcattaccattcacttcatcctggaatggtagctaggacctgtgaaattctgtagcaggatgcactgctttcatagcatgcatttcatgctgcctggtgttgaaggtatttgtgtaaggcttttatactctgtgagagctttgagcttctcaagggccagagctgtaacacatatgtctttgaattaatatataattcattgctctacacaaaggtacatacttttttttttgttttctgaagtgcagagtgctattctaagccatcttaaactcaaagaattatagaaacgttctggcatacagtcagaatatggaataggaagagtgtttcacaaagtgtgataggcatcctaccacacaaagtagtgtttgctttaatagattcatgttcatgttactgtgatttagaaaaaaaaaattgtaacatcaaaccaatgaattctcagatattaatgtttaggatggtgttaaaacagagacttatgttaggcttgaatcaatgattaaatatttatttgagggtcaatgttcaagtatgacaatgtagtaaaatagtatgtgaagaaactaggtttgttccatgttaacttaatgcagttctagactggaaatgaggagaattgaaattctataggcccatcactcattgtgtgtgtgatcttaagacatttttacctcttggcatctgtatcttttttggggggtaggtattctgttatcatctaactctaaaagtgtaatttgctactaagatgcctataaatacagccagactacaacacagatggtgcacacaggaagaaaatctctgattggtagactaacccaaaataggctgtgtatatattgaatgaaatacgaccaaaaaatctgcaaatagcagacacagagcatcctttaggttggaactgagtaaagtagatttatgatctaatcttacttattctatgacatttctgtttaatgaatgtccctgatcctcctgccatcttactcacatttctaatgtgctcatactccgaggtaataatgatcatttgcaattataaatgtcctgttatcaattaatttgcagttcaccagtaaccatctgattatctctaacaaagctgcgctggtgtggtaattatgttgagagtaatcatcatgtaattgcacataattatttgtaccttattaagtgctcatatgattaaaatatttctggtcaaataaaaattatccgtgagagtattttttggaggggggaaataagaaatgttgcttcctggtcttctgttctttgaataaggtaaagctgtctagctgacagtccataatgccccagataggatgaattagtaaggagagaagagacttagatttcattaatacaataccttgtacctccaatgaagttgagataataaacttcaacttccagcatggatgaacgctttccctgtagtagctataacaaaaaatattaccctattaagagtgtacactatgaatgtcattgaggacaatgtgtttttcatgtccaacaccgccattagcaattttatactgaacttttatttttctcatagtactctctcttcaaaacttttaatattcacttatttacactcagtgttttttttaatttccagggactgtgtttagtgagatgatctacaggtataattccaaaagcacctaccaaatttgtttattcagacattcattaaagagcaactctatatactagcactctcctttagaaatattatgtgagctacgtagccaaatttactttttccaggacccacaaacaacagcaagaaataggtaaaattaatattagtaatatattttatgtaaaataatcattacttcataggtactcagttgtaaaaaagattagtgaaatattttacattttttgtactaagccttataaatctagtgtagattttacttatagcacatctcaattcagatgagcaacatttcaagggctccatagccataggtagcttatggctgctgaattagatggtgcatatatgttgattgtatctacatggtagataaaggagagtcctaattaatagttagctctctgattttatagatgtttttatgagtttcaatttcctaatctggtaaataatacatctagcctaaaacatttctttttaaattaaaatgttttctagaaggatagggatggaactaacattaagggactgctttactaggtcatgtaggatactaggtatatttacatttattatcaaattcattcttcacaatagtctagaagggtatgttactttacaggttagaaaagtgagatgtaaagtttaaccttatcaatagtagaatagtagaactgggattcaaacttggctatcatctttgaccacagattttgtctcatgcttttcaaataagaaacacatattttgggtccacttgctcattgataggtctagtaagaggattttacttccctgaatactgtgtaaaaggcttgactgcaagaaagttactgattagtttgatttttagggtttctcctgaccttccttatccatgtttcccagtccagtttcttgaattagtctctcctgaaagcttgttctttccagcaaacttatctcaagtatagcataaatcatcttccactggcattttaactgaaagtctgttgactatcacgcacacttacagaaagcctacctttggggataactgagtgactgacagcgatgccttagcaaccatctgattgtagttacagaggaaatttaccttggattgaagaatcacatgccattgtgattgacagagtctgtaagacaatcaaggtcaaacccagagtaaattgagtatgtggctatgagcattgacagataagtcatgtgtcaaatattgcctagccatctggttgctactcatgattagactggattcattgtgtttaatttcttattgaggacaactacatgggaaacttgtttgtttttagtttatcagtgaaatgtgctttatctgctgacataaaatgtttctgcctaaagtgaacttgcaaaatcattagttttatgactccagcatgacctacaaaaaattattatttaaaagtgattgatgcattattgaaaaaaatatattaggtgctgaaagttacactcatgaataaaagcacaattccttaaagaggaataagaaaacaaatgtgatcaccccgagggtttttagaagcccccaaatgtttaaagactattagccaaactgggtaccagatatgtgggtagtgagaggtgatgagatgtcagtgataagtgatgtataaggggacaggtgccttgtgtgaaattctgaaaattcacatttagtagaacgtatcaaacgccagtagaacgtatcaaacgccagcaaatacttagtttatttttgaggacaaaagtggaaaacacagggaagtgaaatcaattgtcctatgtcacattgtacttggaatggggctctgagtcccctgactactaatccagtgcaatttcctcctgtaactttgctgcctttgtaaatgattacattttaaatacaagggctgtttggcttattaattagttagtgttaaaaaaagccaaagttgcttttcatcactgatggattagtacctttcattctgttttcaactaccatattgtccttttaactgaactattaaaaacatttttccttgttgatcacagcttgggtgaacaaagtaggggctaatgaaaataaattcccggtcagagaaaatggcagttgcacgagttttggtggtatgatagtcacatttgcatatgtaaagtataacactacataagcaaataatatgacccaattttaggtggtgatctatatgtcattgctggttcctctgcaagaataaatactgaatgcttctaggcatttccagtaagcacagtaaatccatttcaataatgaagaattcctgagaaaacaatataatagaatcaacaggttctagcaaagtggaattttatcataaattacaagttccaccatgttaacacgtacattgcaacatgttttggacagtacttctgaggttggaattctcagcaagtggttcctattttgacatccagacagtgatagccatttgtaggtggaaaattagttatcagctgtgccttgctttttctttacttgggtttctctatttctctgtctttttacacacacacacatacacacaccccacacacatatacacatatatatctatccttggatatccaaaaaaagattctcaataaattcacaacactaattgaattgagatgatataaagttgttgattatttttaataaagtctagagatctaacattagttgtagcttatttcttcactactaaataagaaattccaagttaagtcttttcatcttttcattaataaatagccaatatgtaatatctgcccatccatatatattatgaactatctgaactactccttataattatggggtaaccagtcaaataaaagtgttgaataaacagcttattgtatatgttatgaattacctgacttaaaattaggagtcaattagtcaaaatgccatgggctatatgactcattgtaacattaataaagtaaaatatgtcttcctataatccagttattggtattaaataatattgaagctattttccaagcaaaacttccgcataagtttgtttttgtcttggttgagaactggttcttttgagataaagccaccaactcagcacaggtttttttttttttctcctgaatggttttgttcaacttaaaatgactgttcctaacagcaggtgctctcttctttgtttcagattatattgaacatgcttttggtcttcacaaatactgaaaatcaactataaaaatgctggatgaaaagaactatatccatatggtaggaagataaaattttagctctaactcatatcttctctgaagaagattcttcagtaagttcaataactaacattatacattcagtcttttaggaaatccttggatctattttcaaaatatatccagaaacagaaagcagctataacatttgactggatctctcattatgagtaaaataaaatctttaacagctattaatcttatacatgatatgacagccgtgattttacctttcttttttaaaattaattttaacagctttggagatccttcactgagatatccagtgggttcaactgacaaagcaaggcacaatttatcatgtaggaatgtacttcacgggaaattttcttctacatatgttttctcttggttcccagagatgaatccgtaataacaataggattctgctaactttgtttttctgattccagttttcctctttactaattccatggctctttttttggggctcattttttgcccaataaattattcccgcttattgacaggactgatttgggaatttaaggtctgaccatttggtgatatctataagtagattcattgtttatagagacctgttctctgttaggcgagagacaatagagaatctagttgttagtctttatctgtttgtttgcttgccaacactgacctcaaataaattaagaattttgtggccactgggcaagagaacagctctttgatatctggactgtatataactggaataatggttatgcacccaaagccatacatggaatgtcatatttgagaatgatagtcacataaccaccccaagctactaagatgccataagtctttaccccaaatgtgtcagaaatggaagacacttctctcctattagaagaaacaaatacgtttggaaaaaaatatttttggataggataacagagaatatcctctccagagaacagggtagtgaaatatattttgttcacataaactgaattttttttttctttttttgagacgtggtctcgctctgtcacccaggctagagtgcagcggcgtgatcatggcttactgcagcctcagtctcctgggctcaagagatcctcctgcctcagcttcctgagtagctgggaccactatcacacaccatcacacgtggctaatttttatgttatttttattattattttggtagaaacgaggtttcaccatattgcccaggctggtttcaaatgcctaggctcaagtaatccaccagctttggcctcccaagggttggaattttacaggagtgagccaccacaccagcctgaaattttcattaaaaggaacttcccttccaggaagggatgaaggaggacttttagaacactagaaatgacagcccaaagagacagagcccagagcatgggtgagggtgagctgtggtgtcttgaaacctagacacttgttggtggaaccagcttgggaacacaggctaattgggaagtatggaaggaggatgcttcagacacaattgaatttttcagtgttactaggacatctattcctgtgtatgaaccacccgcctgctgtggtttgaatgtttgtgtcccctccaaaactcatgttgacatttattctcaggtgaaacaatattatgagggagggcccttaggaggtgataaagtgccttataaaagggcttgatggggcgagttacccctccatcccttcatgtaaggacacaacctcatcccctctggaggatgcagcaacagggcaccatcttggacacagagagctgccttcactagacactgaacctgctggcaccttggtcttggacttcccagcctccagaagtgtgagaaaaaaatttccatgtttacaaattactcagtctgtgttatttggttataacagcacaaatggacaaagatactggcccttctgcaaaaattcaggtcctcaaaatctttgtgaaggatgtggcttttgttactttgctttgcttaagaagggagagtggtctacaatcacagggttgtttacctgcaagctcctcctgggcctggattcctcattgtgcaactgttgtgttatcttcagtgtccacaccactcaaagacaactttggtttgaatggagcctggcctgggctttttacagaggctgacattgatttggcattctgcagggcaccttgctgacttttgttttctctcttgggatgtatccactgagacaaatgactcatccattctctgaatttagttttctgaggagtctgtcttctttggggcagaaatggggacacattgctcaccacggtctctctcttcctctgacctttgcaggaaagtgctttccctctagtgtgtaaagtccccaaccctatgtccaaattctggattctttactaattggaaactgctattataggattcccatttttttcacttggctctaaattagtatcccagatctttcaggagggtctgaaacttaggggattcgagctcttgctaccccagggcactttccatatgctctaagtggatctataaaacatgggaaggtgccatatccccacagtgtatgctatggggatgaggctgtgagccattagcaaattttctgggtcagtgggcacttcagttgtacaatcatgagcccggctctcagtctgtgcctctgtttagagttttaactaagaagaaagatggtcttcggggtgtgatttccagagatcttggactgccaataatggtacaaagtatttcttggttattacagcccttagactactcaaattgtcattgaatatttgggagattctaagctaattagttctctgtgtgcttaatttattttctggttttgttttatgaggcatgtgggactccatagccttaattataacatatccttggaaccattggtcttttcttttttaactgtttttttctttttttaattttttattattatactttaagttctagggtacatgtgcacaacgtgcaggtttattacatatgtatacatgagccatgttgctgtgctgcacccattaactcgtcatttacgttaggtatgtcttctaatgctatccctcccccttccccccaccccacaacaggccccagtgtgtgacgttccccttcctgtgtccaagtgttctcattgttcaattcccacctatgagtgagaacatgcagtgtttggttttttgtccttgcgatggtttgctgagaatgatggtttccagcttcatccatctccctacaaaggacatgaactcatccttttttatggctgcatagtatttcatggtgtatatgtgccacattttcttaatccagtctatcattgatggacatttgggttggttccaagtctttgctattgtgaatagtgccgcaataaacatacgtgtgcatgtgtgtttatagcagcatgatttatattcctttgagtatatacccattaatgggatggctgggtcaaatggtatttctagttctagatccttgaggaattgccacactgtcttccacaatggttgaactagtttacagtcccaccagcagtgtaaaagtgttcctatttctccacatcctctccagcacctgttgtttcctgactttttaatgatggccattctaactggtgtgagatggtatctcattgtggttttgatttgcatttctctgatggtcagtgatgatgagcattttttcatgtgtctgttggctgcataaatgtcttcttctgagaagtgtctgttcatatcctttgcccactttttgatggggttgtttttttcttataagtttgtttaagttctttgtagattctggatattagcctttgtcagatgagtagattgcaaaatttttctcccattctgtaggttgcctgttcactctgatggtgatttcttttgctttgcagaagctctttagtttaattagatctcatttgtcaattttggcttttgttgcaattgcttttggtgttttagacatgaagtccttgcccatgcctatgtcctgaatggtattgcctaggttttcttctaaggttttttatggttttaggtctaacatttaagtctttaatccatcttgaataaatttttgtataaggtgtaaggaagggatccactttcagctttctacatatggctagcctgttttcccagcaccatttattaaatagggaatcctttccgcatttcttgttttagtcatgtttgtcaaagatcagatggttgtagatgtgtggtattatttctgagggctctgttcggttccattgatctatatctctgttttagtaccagtaccatgctgttttggttactatatccttgtagtattgtttgaagtcaggtagcatgatgcctccagctttgttcttttggcttaggattgtcttggcaatgcgggctcttttttgggaatcattggtccttgaaggcagctctaatttcacctcatagctctgctctctgaagcacgcctctgctatggctggagtcccttgggggcgtgattcccattcttattcctaggttcacgatcagctgttgtgtaacttatagttagctctgggttgcccttttggcccccattttagtcacattctgccgggttccgtcttagttgtagtgtgtgtgaggacacaatatcgactacatgcagagatgtatttaccgtctgccctaacctgatgagtctatgcagggcccttgcaaatatcaaagcaggaccaccttatgccgctagccttgcttactcacaggagaggactagatgccacatttttctcccatgattatctgttttctctcagctcagattttgagtctgcctctgaaacatgggtttctgagtagggaaaggtggcatggtaaaaaggccaggattgagatgttctcttttgacaccatagttttatggattcaaggaccatgagaagtgcatcctacttctgccacttgtgaaagcaaatcaagtgggttttaagatgacagcaagaatgaaaagggagaaaaaaaaagtgggtttgctatacttgtcaagtgcctggatcaaggaaggatcaaggaggctttctgagccccttgattggttaccttttgagcccttccccaatcattccctaggcagaattttctgcatcttctaagtagaattttcctgggtgcttcagtacaatccacttgagatccttgttcctctggcccttcaacatggaagtccatgagagtccatatttgcctttccattgagaggtccctaataatttatctttaggctgcatcagcaagagtccctaggattctgtaggcctggcccctctcttgttctgtgagtccatgttgaaggccgtgtccaagttgcttcctcatctccttgctgaaaacaaatgcttcaggaaagatagagactaggacttaggatgaaaaggtcaagttctcctgaggaagattgggagctggagggatggaggcttccaaagatctctgggcctcagtgggtaaataaagtccagaaaccttttagctatttctgctgcagtgccatttcaggcatagaatttcaggtagggtgagaaactgtacccatttctgggttctagggagggatactctataggcattaatctgagggagagagggttgaaatctggcctctcaggtacctgtgaaccagacagaaaggcagtaattagggcaaagttgcaggaagatgctggtgctgggccttggggtgggaaacaggttgcagctgaggaagcagtaggaattctttagcctgcattagtatttggatggcaatgggctttacattgaataaacaaagggagactctgttggggaacagctaccacagactaagactatcagctacaaagactccctgtgccctcccaggagagttaactttacttacactgcaaatcatgccccaagttcttgagagttgggagatgctatgtacactgcagctgctctggttgcccttcagtgctctagagggactgaggattttgccctgttcatcattaagtaattctgtggaattcagaaaattcagcccataacctgacctgagatgttttggaaatgacctttccttctttttttattttctgaaatctgaaaatccagtttctttatgactcatatcttcaaatgcttattgacatccaggctaaaaaagaaaaagttgccagcttccacatgcagggtgtgcccaggcaggggtctgtgatgtgtgaagagaaaaatgctcttgatgtaaaacacaatgtgaggaggtagggaggaacaagtccttcaccgatgcctgccgctagaaggctgacctggaagttggggtccatgcctgagtaccttcaaacagaagaggctaaccagctgaagaactcagcagatctctctgggatggtactcagtgcaataacaggcacaacagattgagttaacgtggtatatggtagtgctggaatagagagggtcagtgttgtaggatgtcagataaatgaatcagtttgatccatggaatgggctgaaggttgagagagattgataccctgagagaggagtcagccaaggccatattcttctcgcctccatgttgtccctgaaaaacaaaaaaagaatgaggggctggagccccattctgactttcctctctctaagcaagatggcgctcttcattattcatgaaaaatacgatttccatagaactctgtgtccattcctatgttattcattttttttaaagtgactaaaatattttctaatgctctttgtgaaactctaataacgaactttcagtgagtgattctcaggttactctctcgtcagtagccttcagccaaggacggatgccaaattttagacctgtgattaccggaggttatcatctgatctgatgactttagagactcatcattgctcctcaaatcagttgtgacacaaaggcttggaccagtgtctcctcatacaggaaggtgatgatgaacaagtgctgtgagactctgctctcctgcagataccctgtgctttcttaatagtccatttcaaggtcactgaatcagtgtttgggattctaccccagagtcctctgtgagtttatgtgtgagcgttggcaagaagctttctgcccaactctaacctttgccctgctcagtctgttccactagaatgataatgggcaaatatttcctgagacatttcttctcattgatttagtaaaattcaaagaataacagaaatgacaaaagtcaatctaagcagttgggtggatctagggttcccacatctgacttgtgtgtgtgtgtgtgtgtgtctttgtgttttttttttctgaaataatgataaaaaaagaatttttctagaggaagcacaaaaacagaaggaggtgtcctacactatacagggaaaataaaatagataaaatgcttcacaaagttgagctggagctcatccatgggcataaagggtctttaggagctggaaagatttctccttttttttttctttttttgcatcacattacttcctttagaactgggtaccaaacatgaatactctagtctacagttccaggccagcatctcagagctacgggacagtctgcatgggtggtaggtgggagggcagtaaaagatgaagttacaggacccccattctccattcatcctagcagatctcaccatccatcctgagcctattacatttctacagctttctttgggcttgctgttttctaaattcaaccttgcagcatagtgcatacattggtatacagcttaaggtgaggactttatgcacacacacacacacacacacacacacatacacacacacacataaatatatatctcgtacacacacacacaccactaccttagtacaattttctatacagttcacatatattcagatattagctgggctggtctttacgtctgaagttcttgactttcacctcaccagttcaagacccttgaaagtcttgagttttcaaggaatttttctgatttcccagggcttgactctctcagaatctcctctatcctcatctcaagcttactggcataatgtatttttgtttttgtttttatttggttttgaagagatggggtctgtcttgctatgttgcccaggctggcctcgaactcctgggctcaagcgatcctcctgcctcagccttcctagtagctgtgactacaggcacgtggaaccatgcccaacttataatgtgtttttaatgtggcttttttttttttggcattaacccagacatagaactcaactaccagattattctcaagtttacccaaaataatctattttcacaaggaaaccattactgatcagtatagcccctacattaaaggttttataagtgatacaagctggagaaaggtgggagcacaccccgtagtagacaatttaaaagccattcttagtaattgtcctctatgtcccttttgggctgctttgaccagagacctctcaaacctcccttctgtactcatgtggtgccgccactaggttgatccctctcttccatgacacctctagcccgtaaatatttaacttttttttattagctagtcatactgggcaattcaggtcttccaagttcaggccccaactgcctacaactgaactggaaagtgagtgaggttatctatttaacaaaattctatgtatatatatatatatacacacacacacacatacacacacatatatatttattatactttaagttctagggtacatgtgcacaacatgaggtttgttacatatgtatgcatgtgccatgttggtgtgctgcacccattaacttgtcatttacattaggtatatctcctaatgctatgcctcccccctccccccactccacaacaggccccagtgtctgatgttccccttcctgtgtccaagtgttctcattgttcagttcccacctatgagtgagaacatgcggtgtttggttttttgtccttgtgatggtttgctgagaatgatggtttccagcttcatccatctccctacaaaggacatgaactcatccttttttatggctgcatagtattccatggtgtatatgtcccacattttcttaatccagtctatcattgatggacatttgggttggttccaagtctttgctattgtgaatagtgccacagtaaacatacgtgtgcatgtgtctttatagcagcatgatttatattcctttgggtgtatacccattaatgggatggctgggtcaaatggtatttctagttctcgatccttgaggaatcgccacactgtcttccacaatggttgaactagtttacagtcccaccaacagtgtaaaagtgttcctatttctccacatcctctccagcacctgttgtttcctgactttttaatgatctccattgtaactggtggaatgggatctaattaaactaaagagcttctgcacagcaaaagaaactaccatcagagtgaataggcaacctgcagaatgggagaaaatttttgcaatctactcatctgacaaagggctaatattcagaatctacaaagaactcaaacaaatttacaagaaaaaaacaaacaaccccatcaaaaagtgggcaaaggatatgaacagacacttcgcaaaagaagacatttatgcaaaattctacttcttgtgagagcagttggagttatacagagcaatattttgatttgttttgagctacactcatgtttacttgctctgtgaatggcttactgatttttctcttctactttctaactttacaccaaaaccactattagctccccactatttaaaaaaaataaataatgaggtcaaacatttgttgttgtcatgggcgacatggtgtgtactggtgtgggtgtgagagtgtgtatgtgtgttttgctgtgtgatccaggcatataatagacttctaatacagcttcactattaagatgacaactgctgaaattcagtactgccttttgccctctctctgatttccttatttctctcttagtgtatcagccatgggaagacccaatctttcccttacttatgatgcatctttactggagttgacagctcctttctttgcccatattctcctgcaacacaagtttgtccatagttccatcccctgagaaaacttagacttcaagctgtacccccttatctattatctcttcagtacagaatttcattctttttggaaaattccctccacatatcctagcatctatggcattgtcatttgtggactgatctggccctgacttgtcctaaagcctcattactcttctattaaaaaaataccttctaactttgaaggagaaggaaaaaaaaaagccactcctgatagagaacatcagggtgatagaagggactataaaaatggctcatcaactttattcttcaaaagtatcactataatggaagaaaaaaatgctggaaacttttactggttaaaggatactgtagtaaagagatgtgataactaagtgcagtatgtggccatagactggatcttgaagtggaagatgtacagtgttgtaaggcatattactgggtgaattaacaacactgaaacacagccagcagattagataacatttctgtacaaatataatcatgcaccacataatgatgtttctgtcagtaatgcatcacatatgcatgactatggccccataagattataatgcatcacatatgcatgactatggccccataagattataatactgtatttttactgtatcttttctacgtttaaatttgtttagatacacaaataacattgtgttacagttgcccacagtatttgggacagtcacatgctatacaggtttgcagcctaggagcaatatgctatcccatctagcctaggtgtgtagtaggctatatcatttaggtttgtgtaaatacactctataatattcccacaatgataaaattgcttaatgatacatttctcaaaacacatccttgtgaagtgatgtgtgactcttttcagttcaatgaagttagtaactgtactatgggtacataaaaaaatgtccctgtttagaggaaatactgaaatatctagatataaggttcatcatcatgttgtctgtctcaaatgttcagggaaaataattatatgtataattatagaaagtgaatggggccaggcatggtggttcatgcctgtaatcccaggactttgggaggctgaggcaggaggatcacttgagcccaggagtttgagactagcctgggcaacacaaagagatcccatctcttaaaaaaaacaaattagccaggtgtggtggtgtgctcctgtagtcccagctcctcaggaaactgaggcccaaagatcacttgagcctgagaggttgaggctggaggaaaccatgatcgcgccactgcactccagcctgggtgacagagtgagaccccatgtcaacagaaaagaaaggaaagaaatcaaatgggatacagtgttatattaataataaattgttattggttgaattgtgtccttccaaaaaagatattttgaaatcctcaccacccgtccctcagaatatgactttatttgtaaataggattgttgcatgcgtaattaatttacataatgtcatactggagtagggtgggcccccaacccaatatgattggcatcattataaggagagggccacgcaaagattgacaggcaggcaaaatgccatgtgaaaacagaggcagatattggagttatggagctgcaagccaaggaatgccaaagtttgttagcaaaccaccagaagctatgaagaagttttcgtgacaaattttagagggagcatggccctgctcacaccttgatttcagacttctagcctctggaactgtgagacaataaactctgttgttttaagccacccaatttgtagtacttggttgctgcagtcctggaaactatatatatatatttagattgtagtcaccttgctgtgcggtagatctcaaaacctattcttcctccagtctatctgagactttatatcctttgatccccattccctccttccctacacttgcagtctctgggagctatcctactatccttatactctctgcttctgtgagttcaacttttttagattccacgtgtaagtgagatcatacagtatttgttattctatgccgggatcatttcacttagcatgacatcctccagatttatccatgttgtcagaaatgacaggatttcattctttttcatgtctgaatagtattccattgtctacatattccacattttctttatctgttcacccattgatggatacttagcttgattacatattgtagccattgtgaaaaatgcttcaatgaacacgggagtgaagatgttcctttgatgtattgtttcagttcctttggatatataaccagcggtggtatatattcctggataatatggcagttctatttttagtttttcaaggaacctccatattgttttccttaatatttggaaataactgctattctgatgcaatatagaattttgtagcctaagataagacatatgggagggaaattagcatgtgtttctaagtttggttacctacacaggaagagaaatattcaacacctttacatgtttggcacttgttctgattccagaatatcggtaagcccaccactgacaagtgtcactctgggaatcacatggctattctattcctggaggtttgccatcaaaaacaaaggagcttggcttcctaatattttaagagaaaatattccgtgacacttagttacctagtttggcttgaagcagcctaaagcatcttctaaatgaacttatttctggagatggaattacattcttggcaggaaataaaagaagtcaactttctctgtgaattttcagtaaggattgtggcattaccttatatattgttaagcttttgataaatactcacatgtttgtctgatccatttttgagtataaacttctggaaaaaatctagagatgatatagaaataaataaacttctgcaggtcctataacccatggtatctatgcttaatgaaaattcagaagaccctaatttatacaaagctgttatgtcatctcctaattatattctgtaaagggaacaggctggaattgatgtctctttgctgtttttcagatactctgacttttttgtgttatttggaaaggactgatatgaggtatgtgtgtgaagtgctgattgtggagagaattttcaaaagtggtgtgagagtgtttgttgacatggccaactttatatttttacttttctgtgaaccctactgtgaatcctggcttctatcatggactttaaaatcttttacttaaagtataatctgagaacatatttgttcttttattcattggttggttggttcaatagactctttgtgcatttgttcaatccttcattttatcatttcttcatcacttaattatacggccaatacagaaagtatttattgagcatctactatagtgctagtcatgtaacctctgatttattttccacaatttttgttggtaccattcattcatcattcaacagttactagtacgtaccctataccaagcataaagaaatatagacaagggatcttgctggaaggccgttggctttgttgactggggtgtgttatgtgtgaatcactcctatcttgtttatgctctaagcagtgatccatttctatcctatgaaaaagaaatgcctgggccgggcacggtggctcgctcctgtaatcccagcactttggaaggccgaggtgggcagatcttatgaggtcggaagttcgagaccagcctgaccaacatggagaaacctcgtctctactaaaaatacaaaattagccaggcatggtggtgcatgcctgtaatcccagctactcaggaaggctaaggcaggagaatcgcttgaacccaggaggcagaggttacggtgagccgagatcatgccactgcagtccagcttgggcaacaagagcgaaactcggtctcaccagaaaaaaaaaaaaaaaaaaaagaagaagaagaaatgcctggactcagaactatttcattagcaaatcaaggaagaaactttcttgaagttatagcgactattaaggaacctttacaatttggcatcacttccctagttctctcttctccatactggccctgggcctctactgctctttctagctttctgcggatgctctgtttacctggattcatcctgtgtatgtagtggagggtgatggcacacttttaaactgcaaaagctgtcattttcttttcattctttcttgatttgctagccggaattaattgatatacatttatgaaagaagaagcaggaaagaatccgtatgaattattctgcatttacaatttattgagtacatatcatgtgccaggatcatagttcagtgccttaatgcactacatttctggtaatctgcaatataatcctgtggggataggagttgcttttttcattttataaatgggaagatggagactcataggctttgtcagtcttccatgttaaaatatctcatcaatggtcagatctggatttgaatttcatgttttctggcataaattttctgctttcagctgtatcctaaataaaaaataccagtcttgtgaaaaaatgagagatgatggatatagatacatactttttaaactagagaattctgtccaggcacggtggctcatgcctgtaataacagcactttaggaggctgaggcagttggatcacttgaggtcaggagttcaagaccaatctggccaacaggtgaaaccccgtctctattaaaaatacaaaaattagccaggagtggtgttgcatgcctgtaatctcagctacttgtgaggctgaggcaggagaatcgcttgaacccaggaggcagaggttgcagtgggctgagatcacaccactgcactcccacctgggcaacagaggaacagaggcaacagacactctctctggaaaaaaaaaaaaaaggagagaattttggcaatgtagaattctcttgacgggaacagtatagcagatatttcagtttcagcacatggggttcctgattagtgacaaattcatattgaaccataaatctgtaatactgtcatacaaggagtaaaatgtagttgtcttcttgctaatgctccttggaaagtttcagtcttttcctattaacttggttgctctcagttttattaccatttgaaatatatatcttctcatatcacagcaaaaaataatgactttggatgatgagtcgttttaatgtttgaacagaattacacatagaattcaaactgttgtcagctttcaagtttgtattatgctgtttcctagcaggtacatgcagactgaaagtatttgtatcatgatgatttttactaactttacagtaattttacttatgactttacttatggttgtgaaatcatacagagatatgttatatcagaatgtcaaaatgcttgttttaattaagatcccagaaaatatttatttccaaatatccaaatttataaataactttggagctctgaattagcataaaatcagtcaagaagaaaaagagagtataaaaaaataaaatatatttcctcctctcccttccccatcatcagggactttcatagaatatactcgagacttaatctgcttcattttgaatttcattttcaaagctatttctttttcaggctgcccattacactttatttgaaaaccagctcttatcatttagtcattattgtcacagatcccaagttcttaaattatgctcatcacaaaagatactagttttatgttctcatcccattcaggggctattccaatataccagccgagggccacattggtgacattcagcacagatgacagcttttgttctgagcaggcacacaaagaaatgactggggaagccgaatcatcgtttcactaaggcaaggaagaagtgtctttctgggtcatgcagcccatggccaagagatgtcagaatacctacagcaaacatataagcagtataattagctcattgtctctagctgggaggaattccccctcacttggcattattaatccagacctcctaaaggccaaagtgttgatagcctgcagtttgctgaaatacatattgaactatgcattcttcaaaatgcagctttagctaacctcctgcatgaaggattctgtgactccaccctctacttccttcttcccagttgtattatgttcctaccactattctggcatttctcacgtgtacttttaaagtgtgtgtgtgtctctgtgtgtgtgtgtgactctctttttgattgtgagtttttctactgcagagatccctccgtaccttctctccccctgtccctaccatatttttattataaatatttttatagattgatagctttgaaatgattggattttagcagtataatagaatgaaacacctggattctgcttctgactccatgagtacagggagtcattgaataatgattcgttattatttaatgcttttatttaacatgtgctaattgagtgcctcctatgtgccaaactgttctggtgctgggaatatagtgatgaacaaaatagtcaaaatatagacaagacaccgctgttctcctagagtgtgcatttctgtgaagaagacagacagtaaataacatagcatgtaaataatcaagacaaacacccaatacatggtatgcagagaattaaaacaggaaatgtgtaagttgttactttaggttaggtagttggtgtagctgagatctgaagaaaccaccaatgaaggttaaggacgttcttaacagagggaataacttgtgtagagactccaaagtggcaatgaacttgtcatattctaagcatatgaaggtcattgtgatgagtatgttggatgaagatgagctatcagagaaataaaaaagatgagtggtttggattttattcttgatgcaatgggacagcattggagactttaagctgcacaaggttatgatttagtttattttaaaaacattacccctgcagtatgtaaagaatggattcacgaggataaagagatggtagggatcctccgtaggaagttattactgtagcccaagcaagagatgattcattgttctatgtggtggtagtagagatggagatgggtggatagattttgagatatgtttgagatagagttaaagatgtgctgatggtttggagaagttaagtaaggggagaaatcaaagtcttagtaaactttggtaagtcacttaaatatttctagtaacaggcccttcataaaatggggattacagataaatcactggttcccaactgagagcaactttgctcctctctgtttcctcccgggacatttggcaatttctggaggcatttttagttgtttatgtgtgttgagggggaggggttctattactaacattggtaagtacaacccagggtccaaaacatcttacaatgtacaggaccaccccttcaacaaagaatgatctagcccaaaggtcaatagtgccaaggttgagaaaccctgaaatagcaccttacaaggtggttgtgaggaccagctaaattaatatattttaaagcaggatgaaagttttaaatgctctgcagagacaaagtgttattgatgcctcaattttacagtgtctgttggggtaaagataattcattcttgtagttccaaagaatctcttctctcctggtcctgaatgaatgtggtgcattttgaatgtgatactttgggccatagcccccttatgcttcagtagagaagcagagaagaattgaaaatttgggcttcaagaatttttttgactccactacagccataatttaaaattttgtggtagaaagtctggttataaaattcactagaaatgagttttaaagtaaacttatttttaaaaggaagtagtgggtgggtgaatgtgagactttagggggattgtgccaccttttttccctgagaaatgccaagggaactaattaaagaagctgaagggagagcaaaggcacgaatagagtagcctattctccattccttctgtgtcaaacaccccacgctacactctacactaagctcttgttagtaacctcccacaggacagggcatttgccctccagaaagttggaccttaaaatgagggaaacaagtaactcttacctgtaattagcttcaagaatactccctcaaatgaaagagaagttaaaaaaactgcctcaatgagttcttaattgggtacaagataatgttggtagaagtttaaaatatttaaccagcagtaaatattcaaggcagtcatttgaagtaatcaatagctaggtgaatgcatacattagctggcagagaatcacttaatcaacagttcaaataaacaagaggagaattcaaaatgcagatctgaaaatacagagaattagcaaagatgctaattacatccaggtaccttcttcctccagtgactacttaaacatttgccaaagtattgctaaaaataaccagttctgaaaagattcatttcttttcagaagagctgcttacttagagagtgattgatggccaggtccagcaggcagctagaagtacccaaaaatgaagtgctagtaggtgacctcacaataaaaagccttgagaatccttcagctggcatgcgctgctggcaaaaaaggatatttttttaaatttttatttttagtctttaccacttaaaattttcagacttttctccccgcttcagatattatatgatagattttatcagatagacagtgagccatttatgataatatacagaaactgacataatgcatgatttggttcatttaaaaaaatcttacttatcttcttttcccaatccttctcaaactcgtctacacttcccacatataaaataaaatatattaaaaaggcttaaatcttacacaggaggctatttttagtatctccaactagaagactgaagctcttaactcatctactagagtcacttgttagaaggagactttcctacaggcatttttattttgctttttgaaggaattatgacaccccctccccaccaccaaagaattgctgtttctacctctagcttcagtagccattaagcagttcttcattttgaaggatacatatagatccagaaacattttctggttggagaaaaagtgtgtattttcaaggttccctatctttaaggttcctagttcttattaaagtagcaggataatcagcttaatgggtggttgcttacgctttctgtgggaaaaccatgggggtgggagttacaagtatttgttctaatttcagcctcattactaactagctgtgtagacttgggcaagtcatttaccttgaatttcagcttagaggcaggattgttaaaataggatcaatttgtaactggatttgaaacctgatcagactattagaaccctactcaagacttaattactgagtctaggtgtttccaaagtctcaaggtgatggattcttttacagccagtgtttgtgcatcactgataattcattcccttcactttgcagcactgataattcattcccttccatttgcagactatagaaatttaagtttcagagaagcttagtaatttacttaaggtcacatagctagataataatgaaacttgaactttaaatgtaacttactgacccccaagatattgctgtttccctattattaggtgcttatttaaccggagaattgccatgtgttttttgtaacaattacattttttttttctttttgagatggtgtcttactctgtcacccaggctggagtgcagtggcgtcatctcagctcactgcaacctccacctcccaagttcgagattctcctggcttagcctcccaagtagctgggagtacaggtgcatgccaccaagcctggctaattattttttttttttttgcatttttagtggagatggggtttcaccatgttggccaggctggttttgaactcctgacctcaagttgtctgcccgcctcagcctccgaaagtgctgggattacaggcgtgagtctctctgcctggccacaattacaatttaatattaaaatatatacatatgtgtatttctatacatgtgtgttgacttttacacagtatttaacattttcaggtgtgtaaaatgaaagcattaggactaaatgatcacatagtgactatttggctcttttagagagaatgtgaatcactacctaccatttcactgatgcacactgtttaaaagatactatgctaggtgttacagttagaccctgagaaatggggtgctactatgatgttgttatgatagccatgcatgtgaataatatccagattctgcttggcccagatacctctccttcctatcatatttctgggagaaatagatgcttaaaaagggaaaagaaagcaaagtagagcatgttatatatacctgggtctttggccaaggtacaacagtataatgtcatgggccatgagaaaggctctattttctctaagttaattagagaaaatgtacctgctccagtacgttcctgaatagatgtatccttatacctttgtagagggagcaggcactaagtcagctcactactccaattcatcatattgggaaagaaaaaagagaaaaagctagaacatatccaggtacattggccttctgacctccttgaaagcacaactcctaagaggtgtggcccaactaatgctgtatgattgtccaaaccagatcaataacactccttttggtagaagccagtaaacagaatgttgagtataacctgtttatacagatgagaaatctgacacataagttcaaattacaggcctaaagttgcttactgcatatttcttcccttttctttcatagcttcatatatgtgtatatatgaatatgagtggtatgagtgtatttcaaacatacatatatattccaaagattatcatgtaaatgtcataaacaattgtaacatttaaattcttaaatttaatagtaagatatgttttataacatgtatctgagtttttatattcattcattgttatattccatcaggagtcatgtgaatacttaaaaatgcagagcaggtaacttttaagatctttgattatacactttaataaataggttcagtaaaattcacatttcttgacatattcattactcagcaagaattgcatacatctttttaattattcccaaacattcaataccttcaactcttaacaatgaattaattcctttgaagttattatacacatttaataaaattatatgtaactacgcagaaaaataatataagcttctcttttgatcctaaaagtagctaattcaactgtttctttctgcagttgtaggaattgttcacagattcttcttgaagttttgcacttttgtgtatctctacttgttttattggttaagcaaagtaaaacttctgaatggcttttgaaactgtacacaaaactcataaacacaacctttaaacaactattgttaaagtaagaaaaaaacaattaacttataaatctttttcctcttttcagatgtaggtcacaaaggagaaatgctcctctgttaatttttgtttttttttaaaagaactgttggttttaaacttctttttagcctactcactattctcaaaggatgcaaggcccccccatgggataaagtcagctttgtcagaggaatatcagcatgtcagctcctgaagaaccacttggagtttgaatagtaacttattgagtggataattgagaaagctgagttaggacaggatttctggccctaataacatatgaatgtctcataattatcagtacagaatcctatgaaatctaatgcttactttgaaacatatttatttaatttatatgtaagtatttatttatttgtactagacagatacaggttgggaattacttaggttttgcttaataaaatagttacttttttcaaaaacatgaattatcttttttctttttggtgagaagaggtcatgtaaacaccaattgtctagcaagatttttgtattgctttttattagggactgttggttttaaattgctttttagcttactcatcatacttttaaatacatggatagttttctgccatatccaagatatttttaataataaaaagtttttttatttctaaatatcaatattattatgatttttttccaccagtgaaaaaatacagtgataatgcagggaagtataattactaatttattttgtaatataattataaaatatatgtaatataattataatatacttaatattttgtaatgtaattacaaaattaaacctaattttatacttctttgaatattttgggagtcaggtggtttttctctaactcaaacttctaccagagacttgggatcccatgaactgtagggacttctgtattcctggaactggtttgggcctcaaataaaacctgctcaagttctcactcaatcgtaagctcccaaagggcagagatgatgtctctctgattttcaagggactaacccagtgacaggcacagaatggccatttagtaatgaatgacaagggtgctcatgcaattttaaaacatagtccctcagcttttctgcctttgagtccaataagcatactagaaacccagaacgaagctagtaatatttgttccagtaaagtgacatgtatatggttttcaaaaaaacagctgtttgttttttttagaagcataagattattaaataaacttctgtaatgagtggataaaatggtgtatcctatgaaaacaaccaaagaatcactgaatcagcagttctgaaagataaaagtctcattttgaggaaatgcaaaacaactgaatgcattttattactttgcatttaaagtaggaaggtggcaaatactcggaagggtattccagttctgtttctttgtaggcagttatttttactgacaggtgagagtgtttcacctttatttgttttatagatacaagctcttacaatgttctttttccttccatggaccttctcctcttctatttcttaccaagtaaattattgaaacaaggctattttgaggtaaaacgaggaagagaagtaatacctcactgcaacctctttccaaacaatagggaaacatcaaagttagggtcaaagctaatactgtcaacttataaaagagctcactcatcatgtctaactttctttgacagtatctacaaaggcttctgtatctagggatgattttattgtcaatatgcaatcaggcaggtcaatgttcatttcatttgtgaagaaaactacatcaagcaaatttcattataaaacctaaaatcaatatacatttgtgtcagtgttctctaaataatgaatgtgaatactccttcaccctgaaataacatttttaaggattggatttttctgaaaaaaataagaagacatatttggtttttctttgaacaatatttgcacttgattctaagacagtgataccaggaatgacttttggagtcggttttgttttaaatatgtttattgatcaattatggcccctatacaagttgagactgactcgagtaatgaaatattcagacctatcaactggtaatattagaatagtgataataagcatagctagtatttgcttagtatgcattatttatggatactgtgaaggaattttctttcatttttcacatttagtctttgtaaactgccttaatatagaaatacaatacagggatacctcatccgattgcagtttgcattactgcacttcgcagatactgcttttttttttttttttaaagaattttaaggtttgtggcaactctgagttgagcaaggctattagtgacatttttccaacagcatatgctcactttgtgtctctttgtaacattttggtaattctctcaatatttcagactttcttcttattattatattgttacagtgatttatgatcagtgagctttcatgttactattgtaaatttggggggtgtcatgaaccaaactcataaaagatggtgaacttaattgataagtgtagagtgtgttctgactactgcagctaccagccgttcctagtctctctgtctctcttaggacctccctattctctgagacacaataatattgaaattaggccgattaataaccctccaatggccttgaagtgttcaagtgaaaggaagagtcatacatctctcactttaaatcaaaagctagaaatgattaagcttagtgaggaaggcatgtcgaaagctgagagtaggccaaaaaggtaggtctctggcatcaaacagctaagtcgtgaaaacaagggaaaagttcttattgaaaattacaagtgaacagacaaatgataagaaagtgaaatagccttagtgatgagatggagaaagtttcagtggtctggatagaaggtcaaaccaaccacaacgttcccttaaagacctaaccctaatccagagccaggaacgaagtgtctaaaattatgtgaagatagagaggtaaggaaactgcaaaaagaaacatttgaagctagcagaggttggttcagaagtttaaagaaaccagcaagtgtgatgtagaagctgcagaaatttatgcagaagctctagttaagatcattgaaggtagctacaccaaagaagagattttcagtgtagatgaagcatccttctattggaagaaaatgccatgtagggttttcatagttacagaggagaagtcattgcctggattcagagcctcaaaggacaggctgactctcttgttaggagctaatgtaactggtgactttaagttgaggccaatgctcattgaccattctaaaaatcctaggaattattttcaaaatattactgctcatccacaatgcacttggtcacctaagagctctgatggagatagacaagattgatattatctccttgcctgttaacataatatcctttctgcagttcattgatcaaggagtaattctgactttcagctctaattatttaagatatatacttcataaggctatcagtaccatagatagtgattcctctgatggatttgggcaaagtaaatttcaaaccttctgggaagaattcaccattttctatgccataaagaacatttttgcgaatcaaaggaggagcccaaaacagcaacattaccagaagtttggaagaagtttattctgaccgtcgtggatgacttacagaggttcaagatttcagtgcaggaagttaactgctaatgtggttgaaagagcaagagaactggaattagaaacagagcctgaagatgggactgaaattgttgcaatctcatgataaagttgaaatggataaggagttggttctgatggatgagcaaacaaagtgattttctgagatgaaatctactcctggtgaagatactgtgaacattgttgacataacaacacaggatttagaatattatgtaactaggtgataaaggagcaatagagtttgagagaattgactgcattttgaattgactgcatttctgctgtgggtcaaatgctttcaaacagcaccacatgctacagagaaatctttctcgaaaggaagggtctatctatgcagcaaacattgttgtcttattttcagaaatggccacagtgaccccaaacctttagcaaacaccaccctgattagtcagcagccataatactgagacaagaccctctaccagcaacaaagattacaactcactgaaggctcagatgattgttagcattttttagcaataaagtatgtttaaatgaaatatgtacattgttttttagacatactgctaaaaaacaatgcacaccagatagcctacagtgtagtgtaaatgtgacttatacacacggggaaaccaaaaactttgtgtgcctcactttattgtgatattgttctgttgatctggaatcaaattcacaataattctgaagtgtattcctgtagcctgggtaggctaaatgctataagcaatagccccccaaatctcagtgtattaacacaatagatgttttaatatcgcctagcagctgaatacaaatgtatccttctatttgtggcccactattttacagagcctctgagtcctctgctatgttcctgtcaatctcacacaagaggagagagagaaggtgaggatagcacagatcttttacatgagtgggcactgggagaggcacctatctcttcatccacattccctttgggaaaacccatcatttggttacatctaactgctaaggagcttgggaaatataatcaagttggctgatcaagtagctatcctctcccataggtagtgttatacccctttatagatgatgaaactaagacttaaagttcaaacagtattccataccatcagcatcatctacgtgtataatggtaacactgagtctccctagtaacaaaaaaggtccctgttttttaagcactgtggtctccttcaaccctgtgctgggtagtttgccacttactatgatttaccctggaaacaaatggtatcttcccattgaaaaggctagctggggagatgcacagctgagattttgactttatgttttattcagggtccaacgcttgattttgtagtagctctattgataaagctaaaatttaataacagaagtaataagtacaacttctggggaaaattttaagaatcagttggcaattcctgtgctccttctttcctcctattatgaaacaggcagtgttctaaataaagctattctgtcaaactgggtccgtattgactttgataagcaagtgctctctgtgggcccatattggatgtgtaatatgagtaaaaaactttccataagtccccgagagctttatttttattttattttgtactggtattattatcaaagcatagcctagcctttcctggctgatacacactttagcctagaatctctactttcagtgtcttacaaaactatttaccaaggtgtgtaagatatgtatgtccctgtatctatttgtctatccaatgttgttcaccagagtcttgtttaataagttatggttgagagaattatgcttgtccatacaatggaatatgtgaagctgattttaaaaaatgatatgatagatctgtatttacctacatgaaaagatgaccacaagccatgattacatggaaaatacataaaagtatatgcatgatatttcacagagtaaataaaaacttattattattgtaggagaatagacttcccaggaccctgaggagctggaggaggtgacagcacgctgcaccattcccaatgtagtccaaggttccggcataccattgtctgcctaaatcaccaagttagcttccttaatggtctccttaccttcagtcttggccccctccagtacattttccacacaatgtagccagtgtaatctttataacagatgattcacctattaaaaaattggggattatctccattgatagcatgtaaaaatccatgtcttagccttgggttcctaaaaaacagaggctaagacaaaacttaaatgttaaacctttcctgggatttacagtccaatgcagcaagagtgagagtctcaactttgcttcactcttctctatggtaagactcatctgtctcctagttgcccactttgtttcacggctttcttgacatcttttgtctttttgaatctgcccatttccttcaatacatcaaaaggtctttggaagcaaaggcgttttgttattaactgttgtatcttcagaaataaaatcatagaagaaaaacaaatcatgatgttttcaactaatgtttgtcaaacaattatgtttagcccataaaacaattttcctgataattgggttttcagagaattcttgaatcacgcagtgtgtattaggccatttttgcattgctgtcaagaaatacctgaaactgggtaatttgtaagaaaagaggtttaattggctcacagttctgcaagctgtacaggtggcatggtaccagcatctgctcctggagaggcctcaggaagcttttacttatggcagagggcaaagtaggagcaggcacatcatatgtcaaaagcagaagcaagagagagtgtggcgggggttgggcgccacacacttttaaatgaccagatctcgtgaaaactcactatcacaaagacaacagcaagccatgagggatccacccccatgatccaaacaccccaccaggccccatctccagcactggggattacaattcaacatgagatttgggtgaggacagaaatctaaactatatggcagcatctgttgctttagttctgcctttttctgtaggttcagagcaaacttttcctaccgtatgcgttgtgtagttttatgtcactctatgccccacattgattttcttcccttatcaatagaaaactatgtgtacgttttcctacatggattataataaaccccttttaaaaaattttcatatataaggcattctaaaacctgtatgataacacagatttgtctgtaccaactactaatgaggaatttaaaggaaaaatttagtgaattcctcacattgaatttaaatttttattttttttcttggttgttagtttaaaattttgaaatctcagtctgtagcattcttccacatggccagccgtgacgtgactcatgagtcaccaacccatttagtcagtcaaattatttaacaagcatttaccaagtattctgtatgagcagacttatggataggctaaggccaactctctgacatatactgtatagggtatgtttttaaaattttccctacattaatttctgttgtcatttttgcatttagctcagtacagatattctgattctgatgctttaaaactgttcctttctctttctttttttccttttgagatggggtcttgctctattgcccagacgggagtgcagtggcacaatcacagctcactgtaaccgcaaactcctgggctcaagcaatccttctacctcagtccagaatagctgggattacagatgtgtgccaccatacctggctatttttttttgtattttttgtagagatggggtctcactatgttgaccaggctgatctcaaactcctaacctcaagtaatcctcctgtctcagcctcccaaagtgctgtgattacaggcatgagacaccacatcagacctcctcatcatgttgaaactcttcttgaatggacttaaaatgcttctgtattagtctgttctcttgttgccaataaagacatacgcaagactgggtaactgacaaaggaaagaggtttgattaactcacagttccacatggctggagagacctcacaatcgtggcaggaggcaaatgaggagcaaagtcatgtcttacatgacaccgggcaagagggtttgtgcaggggatctcctatttataaaaccatcagatctcatgagacttactaccacaaaaacagtatgaaggaaaccaaccccatgatgcagtgatctctacctggccctgcccttggcacatgaggcttattacaattcaaggtgagatttggatagggacacagccaaaccgtatcagctacctaccaatttttaaataaactttaatttagtttaaaatagtgttttttcaattgttgcatatttgaattgactgaggactttaaaaaatggcagtgacatatccctgctcttagagattctgatttaatttatctgagatgagaaccaaagatattttctaaattcaccttgtgcaattcccatatatagcttgggttgagatttttgactgaaaataatatttcccaaaatgtgatccacagatcattggagatttttatgaatctttgagctcatcagagcgctcatgatattaatgtggatttttttcctgaaatgaaataatgaatttttcatttttaaacctcctaagtatcttctcagaatgggcatcaatctcataaatgctgtggtttgtttggtgttagttagcaagttaggaatctggttcactgaatgaaattactgttttaaagtatcagaaaggacacactgagaatgttggagttgagagttttagtcaagcacatttaatttatggatgaggaagttgaggccagagaaatgagatgttttgtctaacttcacatagctggtctgttcaacactacggagaatctggggctcgtaactttcagtccaatattctttctgctttatttaccccttgcctccctggagccttgtcataggcttcaggcttcacttgttccctctgagccatgtcctaaaaattccaccatttgttattttaatcccaatgctaaattctaattaccattcagtgaattactgtacagtaagcagatgtgtgttattttctaggggaaataaaaagctggaatgtgatctacacctgtaccttcagcagtgtttctccaccaagaagtagcaatcagcattaatatataaactcaagttgccagagtctcaaatgtagcatatgcagagtgcagggtaagggtttctcttgccaacagataaaatgcactccaggctcccattggtgttcgcaaatgccagtcaccaaaagtcagctttccccctgaaaagcaagttttgtttttgcacaattaaatggtaccttggtgaaatgagatagagcctttctcataggaagtgatttttctgggagcataaagtaacaaaatgaatctgttgtggatgtgtttttgttgttgttgttttcttatattgcacacaactttttaaaatgacagaagttggaatgaggttggcaacaaaccacgatgggctcattggcatgctatagcccttattgtgttcagaaattaggatagaaaatgcttggaggcttatttcgtactgtgattcattgcatcatgtcatctagtggagtattatgtttgtttcattctaatttcatggtgataaattctgtacttttcccacctgggcttaacctaagtggtctccatgattgggaggagggaatgattttttaaatgtatatttgctcaagatttgctcctggatctcctgaagataaggtgagtaatgtggtgaaagtacttcctctcctgagtatggaaatctggttcagtggtagcttaaggggatacacacttcaattgaagtctgaagcctgcatatttctacatcctcaaacaggttagcacttcggagcagtggggggtttgtctctcaatttagacacctgatgagtagattatagtgaccagtttcaaatatgtcttcatggtagtcatccatgatcagacaaatgatcagatttccgtgtatttaatattgagtttttataaatgtctgtcattttcttttcttgaaaggggtgatgtccatgcctccatctttcttttacctttcaaaaattagtgatggtagcaaaacagacagtttctcagattgaaggagaggaaaattatgcatgactgaattttgacattatgagttgacatcacagcatacatcctcctaaagtacaatttgacaacaaaaaaatcacaaggtcagaaagaaaatcatagagcccatccactcaatctcttgaaatcaatcataatgatcaagtgaaaaccatcaaacccttaggtaggatagcatatctgtgaggagagtgttaggctgcatcccagtaggtacattaaaaaaaatctcagtgagtatactctttagcattgttaaatataatctgatattcttatttaatagtgattcagaatattggaggtcactcaaaaagagaaagttttgcaaagaagaaaatactctttcgggattttaatttttaaaactaaattataaatattcaaaacataatgtacagaagttgataccaattcatatccatgtattcacagcctttgaaaaaatgggattatcttgctttaggttcagtttagttacagacgcaattgaattcttaaactacagatacaaacatatcctttctcacctctatctcttcttttctgcctcttcagatgtattaaatattccaaagtgaatgtttccttcttattcatgagtttatacttttgttacaaattcatttatcaaaaaatgtatagtatttggtggtgttaacatatatttaaatgacatgctataatacaatatccttggctgctggcctgcttccccctgtatttgatatgatcaacatggattctagttcatttattttaaatgcagtgtaacactattttctgactgcaccatgatgtatttacctgttcttgtactactgggcatttaagcttctttttgggaaaccacagcagtgagtttttcctggtatatacagcctcctgatataaacatttctctagggcatattcccacagatgttgaatcactgggttgtagggtacgtgtgtcaactttactagtattgccaaattgttttctgaaatggttgttctaatttatattcctaccaacagtgttaagagttcccttaggctgggcgcagtggttcacgcctgtaatcccagcactttgggaggccgaggcacgtggatcatgaggtcaggagatcgagaccatgctggctaacagggtgaaaccccgtctctactaaaaatacaaaaaattagcccaggcgtggtggcatgcgcctgtagtcccagttacttgggagattgaggcaggagaatcacttgaacccaggatttagaggttgcagtgagccgagactgtgccactgcactccagcctgtgtgaacagagtgagcctctgtctcaaaaaaaaaaaaaaaaaaaaaaaagagttcccttaaacttctacacttttggtgggagtgtaaattagttcaaccattgtgaaaagcagtatggcaattcctcaaagaactaaaagcagaactaccatttgatccagcaatcccattactgagtatatgcccaaggaatataaatcattctaccataaagacacatgcacacgaatgttcactgcagcactcttcacaatagcaaagacatggaatcagcctaaatgcccatcaatgatagattggataaagaaaatgtggaacatatacaccacgaaacactatgcagccataaaaaaggatgagattatgtcttttgtggcatcatggatggagctggaggctattatcatcagcaaatgaacactagaacagaaaaccaaataccacatgttttcacttataagtgggagctaaatgatgagaacttatgaacacagatgtggaaacaacagacacttgaggtctacttgagggtggagggtgggaggagggagagcagaaaagataactattaggtactgggcttaattcctgggtgatgaaataatctctacaacaaactcccgtgacatgagtttacctatgtaacaaaccttcacatgtaccccgaacctaaaataaaagttaaacaaaaaaagaatgcaaaacaaacatgaatcaacacctagaatgagtaattacatgagcatgttaacaatattaatattttgttaatgaaactaagggtggtggatttcaacccccaaattttcatagtgtgtgttacttttataatggaaaatgtcccaataaactatttttaaacctaaaaaaaggagttcccttaatttgcttatagttgatgttatgccctggctggttccagtctgcatacccctcctcactccatagttacggcctcttgaaaagtcttgcggtctcagtcttatcaacttttcttgaacagatattgccctttcttagcaggtttgatggagctgcaatccactaccctttagctcattggtgggttgtgcctgctgcaagtttgggttttattttatgacttcaaataactagacttctcttttatattaaaagctcttggccccacattctgaaaagtagatctttctactctatctcagctgttgctttaggatcctacatgaaatgtaggatgagactttatctgacttaaagtttctctcccaaggattgaaattcagcctctgaaattcagtctgcttcccgggactttgattgatgctcctgggcttttctgtgacatgagtcttcctcctcatgcttcaacaaccctctcttgtctgcttttggacttctgtctctatttctagaaggttgtcctttatttgttaccatacttgcaagcagtgtgttttctgactgggctccctgtcttgtcgcctttctgacctcgagggctggtctagttccaggatgagttaatcttgttcctctatggattctgccattgatgccattaaagaacaagatttattgctgtcacctccagaagtgatttcatgctgtttgaaacaatcttgtgcaaagtgttgtcaattaaaacaaaaccaaacaaaactgtttcctttttgagtaatctttgaaaatcataatcactttcaggagtacaagatattccaatgtcttctccatagatgtgactaatattcacattctggtggccaagctgcaaatgactgtctttggctcaaatatccagagaatatcgcaaaaccaaaggcctgagaaaagcattataaagagagagagaaaaaaatctctttaacaagggatttctgaagtaatatgtgttcattttagaaaatttggaaaaatacagcaatgcaaaaagagaatcatagatgaccttagaacaactattaactttttgcaccagttgagatataaacatacccacgagtatattagtttaataaatgtctgagtgcctacctagatgctaggagtaaaaagagagtgataaataaatcaaacgtagatctaccacttagggagtttaaagtctatcagagggagtcaagtaacagataaataacgaaatttgtgaaaaattggaaggctggtatttctgacaaaaaatcatttcctctgagtttcacaggatgagaaaaacaggcacgtgaagatcaagggggagagtgcttcagggaaagggaaatgcatgtgaagaatgtatacaggcatgagagaggttttattgcctaaatttaggaagagacaataacggctttttatggtggagtcaaagggagctaagaatgtatacactgttaaaatgtgcaatctaattttaatgtacaagtagtaacagatgaattaaaaattaaaaagatgtactttagaataaaataataggatatatttttattttttatgaaattgcaaacatgtatatactattttaccactttcttttaaagcataagtctagctaggcatggtggcatgtacctgtagtcccagctactcgggaggctgaaggaagaggatccctcgagcctgggagttcaaggatgtggtgtgctgtgagcgcacctgtgaatagtcaccacatgccatccaacctgggcaatatagtgagaatccatatattaaaaaataaaaaaaagttttttgacacatagccaagtctaaacatgtagaaatttacagattggcttaaatatttgtgataactataaaaattccacatctccagctgtctatatgttattcttacacacgtatgtagtactaaaccaaagggatctttttccctgatacaaatgtggagtaaaagtttacatacagcaaagaaggattgattccagcctacaattctactccctagaatttttctatcatgaatgaagcccttccatttttcatcacgataggagtggtttatcagattttcctagagcaattccaattttgcttatcagttaggactaaaatgtgtcatcttcctttctatatttaggaactgtaggaagctgtgctatggcatgtgagatgtgaggagcatctgttagagagaatgccggagctgaaggtgtgagaggtttcaagaaacgataagctttgggctcagcttccccctaggattacaaagggcttgcacatattagagagctaatttttagcatatttccatgaaggcagattttatcttccataaatgcttagattcatagaaatggtgagttggctcaatgctgatccttttatgtctagcttgatgtttacagtaactctggaggtagagggttagtgatttatattttaaccagttccttgtttaacacaatcatcttatcttggctattgcttaacactttttttagggctccaaagaaatacatacatatgtataaaattgttttggatttttgtgtcccagtgttacagaaaatttctagaaatatgcatgaaccagtcagatattctctaagtgagtttaattttatttctttgacttacattttatttctattagtatacctttcagtgttacagaaaggcagatctaccatttgtgttacgttggatttttcaggccattgcatccttttcctgtttattatgttgaggccccctcagttatccactgaactgattaccaaacaacctctcctagagttttggtgttatctctacctgttttttcaaccacgttctcttgaaagaatctttaatttaggctcatatctacaataaaatataataaaataatggctttatttttgttttaattatgacaaggtaatttatgcctgatttgtttatttacttagaactcataatagttattcacatttcagcctgatttaagcattattttttatggttgttttgagatggatcttaaaccatcaaatgttcccagcaaaagatggcatttttttcagaaatatagacattaaacttaatgaaacttactttgccaaattcataccatgcttctatttatttccctatgataaataccttcttacatctcatttgtttcagattatctttctacttcctattacccaagaaaatattgtttttttgcttgttcaggtcaaatgtttaaatcaattgatcaatatttcagtacttgctgttagacaaatacaattactcatttcttctctgccatcactcagagtgttttctccttctggtatactgttcctctcttgtcatgttcttttactttcactgaaacccttcctcagttttaaagtggagctcaaatcacacattcctggtgtcagtttgtccattttctggatttccccagatcttctcatttggaattacactctcccttcagtaatcattcatcatactgtgaacacttatcaccacctgccttgtgttctatgtaggtgaggatgtttttgttttcccactgtggtaacaattactaatggacaaattccctacattttgtaaccctcagggtacttaccttattcataatatgtttccaggaatgttgagtacattaaatgagtaagtttcttagccaaggtattgattccattgaatttactggtcttcaaatatttgtatctgtctactttgtcaagatatgtaagaaaggcaatgaatgacattaatattttccatggaaactaccgactttcagttctatgttacctcctttcagttctgttttacgtctgttttagccttgcgttatcaaatcaattaacttttgaagcctcagtttgatcatctgaaaaaaggaaataatgatatctcctcattgttgtgataattacatagataataattgcaaggagcttgacaccatactgtagcatatagaaagtactcaataaatgccaattaccatcaacagatagtaataactgttactattgtcttcatttttaactttttactcaggatacatcttaggtatccaaggagactgactctggaaaaaacatgaattagaactcagatttcctgatagtatctttatcagaaaaaaggtagagaagtgaatatttctgtccattttatgaaaggacaatcttgatgcacattaatacttcatctcaagccagaatgtaagattcggactggggccatcaaataatcctgcttgagtgattctaccttgtttctaagtagtcattgcctgcagagttttgatgaaacatctaatagagaaattgtggagaggtatcatatgtaattgacagaatacaattggttgtactgaaatatcttccttatgctaaaagaatgaaaacattgatgcatcccagatttgtgggcctttcgttggaagtttgtggagatggaaatttaatgtaaagggaaacatttgtttttcctctgaggaagtctgaaaacttctgcatttcagattttaggttaaatttttcattcacattaacatttctgtcttttagctgatgtatagctcaaaatatctcagatcccctacctcacaccatatacaaatactaatttaaaattaattacaaatcatctaaatataagagccaaaactctgagaagaaaacatgggagaaaaatctttatgacgttggattaggcattctcttgagataagacaaaaaaaaaaagacaagtgacaaaaggaaaagatagattgcactttatcaaaattaaaaaaaatttccttcaaaggctgccattaaagaaataaaagacatcccaaggaggtggagaaaatacttttacatatatatctgatatgggacttataactagaatacataaaatctcttaaaattcaacaataacaagaataataaccaagttaaaacatggcaaaggatttgaatagacacagcttcaaagaagatatactagtagcgagcatgcatatgaaacaatgctcaaaatgattggtcatcaggtaaatgcaaataaaagtcacaatgagataccctgttacaattactaggatggttaaaataaaaaagacagtaataacactttttaaataataagcaaaatgtgcagaaattgaaaccctcatacactgctggtagaattataaaataatgcagccaatttggtagacatcttaacaattcctcaaaatgctaaaatagagttaacatttcacccagtaatgccactactaggtatatacccaagagaaatgaaaacataaatgaacaccaaaacctgtgtatgaatgtttataacagcatgattcatagttgccaaaaagtggaatcaacccagatgttcattaactgataagttagtacacgaaatgtgtttatatccaaatagtggaatgctgttcagcaatgaagaggaatactgatgctacaaaatggataaaccttggaaacattctgctaagtgaaagaaagtagtcacaagggatcacatattatatgatactgtttatatgacatgtccacattaggcaaatccatagagacagaaactagataagtagttgccaggggctgggaggagaggagagtaggcagtgactccaaagaaaacatgggagtaaatgtatgtgggctgatttttgtgaagatgaaaatgttctgaaattgggtggaaactcttggaaagtactaaaaaccattgaatcatatactttatttttaatttttttaaataggcacagaaccaatacatgaattgtatactttgaaggagtgaattttatattatattaataatatctcaataaaactcttgagggatataagaatttatacgcacaaccccccacacccccaacacacaccccagggtaccaaacagaaaaatgagtcagattcaggctccctagtaaaacttatcattataaataagctatcgttggccttatcaaatgtgcttcctgaaaagaatgctgagatatatggaatttgtaagtcagattgtcattctgtcatctttctcatctttctctaaactaaacaaacactggaattaccaccattatgtttgtccacattgtttattaccttccccaacccctaaaagccactacagacttctaatccatcataaaagaatctgacagaagcccaccacgatgacttaagtatatcacagggaagtcacattgcttgtgctaccatgttttatgccccattttgcattctttggatgcgaattttggctcccaccttagctgcaaaatcaggttgcattctgcttagggcttgttttctgtgttagggtttaccaaatattgagagttaatagcttctgagaaccttcaccaaaggggaatggagagccagtaagtaaaggcactcctttactgttctaggtggacaacttggaaggtaattttacactgttccgtccagttgccctgtgggtgtccgtggtggtaaccagtttaataaccctcccttggattacctttctatccctgcttttcccatgcttcctaggcatccctccatatatccttcccccttctgtttcatggtatcccttctaaaactaaacttcttgtatataagcccttaactcagtgtctgtttttaggagatgtcaagctgacacactgtctgatttttagaatatcaaggaccctaggtgaactacttaatgtttctgtgtctcagttgcttcatctatgtggaataataattattattgcctcctgtgcagaaaagagttgacagagtaggcctgataatgctattcttacagaggcctgcttatgagaatgtcccttggctggcatctgggatcgtggctggtacagatataaaattctcccttactgattagagtggatcaccatgcctagactgtacaatgtggtttatgctgcatgcctgcatccttctgggagtttggaattgtggtacatggtagtataagggagggaaaatggcttcccgctttgacacaaggctggttaacagagaaaaaaaccctaattacatatgtaagtgcagccatcccacaaaacggggtcccacaacttgaagaagggtcagatgattgaagcttatgtagcgtcctgagcttacacaaagggataggaatttggggcttcttggggggcaggtaggtgtggagagataagagacaggagggtgaggtgaatacaggatatcttcttatgcagataaatgtctttcaggtaataaaagttgtctggagtagccctcatatagatattttttactaacgtagatttcttttatagatttaagtttcttttacaaaaggacagcttttcagagctactcctgtggctgcagtttcttagaattaccagccaaatgtatgccaaagaaatatattttagggtggcacattctggtcttctacagtcatattttcgggtggtgtgtcctgagcctcaacaataggcagagcatacctatgtgaccagcttctccttcctcacctgctcctctcaaaaaatacccacctgggcactgagttcctaataggcatccctggacggaaatagtccacatgtgttgttgcatttttgttcctgggaaagacgatagtctgtgagaccacctcatgggagagagagagcataaggaagcttgcacatgagttcctccaaattctacctgggtcctttccccttattattcaactgtgtaccattactgcacagttgtcatatatttttgccatgagtacaacttagattctgagtcctgtgagttctagtgaatctctgagtagaggtctggtcttgggaatccttgacacacttgctatggttgttgagaagattaaatgaggtaatatagaagactttagcacaatgcttctaacatcctaaatgtgcagtaaatgttaagatttactaaagtacatcctgtcagctcaatatggggtatcagttggctctgggattcccgagttaatcaggttgactcaatctgtaaaagtcatattagatactcaagagccataaaatgatattagaagtactaaggtttgggtcgggcgcggtggctcacgcctgtaatcccagcattttgggaggccgaggcgggtggatcacgaggtcaggagatgaagactatcctggctaacttggtgaaaccccgtctctactaaaaaatacaaaaattagccggttgcggtggcgggcgcctgtagtcccagctactcgggaggctgaggcaggagaatggcgtgaacccgggaggtagagcttgcaagtgagccgagatcgcaccactgcactccagcctgggcgacagggcgagactctgtacccaccacccccaaaaaaaaagaagtaataaggtttgaatttagcttagtaatgctcagtgcaattgctttaaaacccaggtcctgccaggcgcattggctcacacctgcaatcccagcattttgggaggccgaggcgggtggatcacgaggtcaggagttcaagacaagcctggccaagatggtgaaaccccctctctactaaaaatacaaaaaagtagccgggtgtggtggtgggcgcctgtaatcccagctacttgggaggctgaggcaaagaattgcttaaatccgggtggcagagcttgcagtgagccgagatcgtgctgctgcactccggcctggacaacagagctgagactccatttcaaaaaacaaacaaacaaaaaacaaaaacaaacaaacaaaaacccaggtcctttcccttcatctttggtacagccaatagaaaatgaacaatactatctcacgacttttctattctcgtcagcatgggcctcttccacaagcactccatttaaagtcattgatctaaacttattctttactgtgctgctctttttactgttcacgtctgccttgacaccattccccatttggggtgcccttcctttgccatcagctagctcacatctgaccccactcatcatggactggctcacatcttctgtctaggaagttgtcatgaaggacttgaatcttatgggtctctccttttaggggatagagtgaccctgctgtagttttaaaatcttggatttgagtacaaggatctggattctgcactatagcttttcctctaactttaagaccttgagcaagttacttagattttctgaggccctgttttgtaatccgtaatgccaagataatttgtttaccagggattatttgccaggctacagtgggatgggggaataaatgtgtttaaatactggtaaaagcattgtgtagatataagacatcaaaatacggcacccacgttttgctttttttttacatatataattcttacctccttgctgtatggttttatgttgccattacattcttacttatgttattatgttttatttcttcaggtagattataatatccttgaaggttggacttgcctcgtctacattttgacactccctatcgtagttagcaaagtagtatgctgctatttgggctccgtaagaatcttatcatgtttattgatgaggaattgtgagtttggaaacaatagtttaaggggatttttggaagaggaaaaagcactggattgagcataaccactttacatacagagcaggagctactgaagtggcagattttcagggttactatggggaagtcaaatcttctacactgctggttaacagcaccttaattattagctgctttagaaataagtgccctattgccctgtaatttcatttcattaattatgctcagaggtagtggtatctgaggcaaacaacccttagatttccactgcaccttcatcataggcaaatatttatcatggatagggctattaagttcttcattaagaactttattaagtttattaaaactttctttctcactgagatttaaaaagagccatttagtagtgacctatgaaaatgcaagtattataaagcagtaatatagactatatattattgaataagaattttagcctttttttaacaaatgcagataattattattatgtgccagacattgttacaagaactttaaaaatattaactactttaatttttgtaactctttgcagtagctgtgatcattatttccattttataaatgaagaaattgaggcacagagtgttgtgtaaattatctgatgtcacacagatatgtaagtgactgagctcacaaaagccagtcaattttgctgtatagaatgtgatagaatgtaccctattctatgctgcattctgttactacctgcgtatttatttatttgcagatatgtgcattcattgtgatgttttttaattatttggggaccaatggcatgtcatatcaaaaaaaaggaaagagacctactttgtggatttgcaaacttctattatttatctttacattcctatattttcacttttcattgtaaatacattcaagaagataagttggtagatgataaaatatggatagattaggaatgctaggtaaatagttccaaactctttaatttgatgccaagagagcaagtaatatgaacctcaacagtccatccttaggtgcttttgtcagccagcttcatagtctcatcatagctgactaatagttagtgtcctttttcattttgcacataatccagcattaaaagcataaggtatgaaaggatgaaaagattatgccccactttacttattcgactaaattattatgccttgaccttttgaccaaatcagattcatcttctctctctctgcacttccacccattttaatgctgcggcacagattgaatggattgggagtctgtgggtaagtaataagaacacagagaagagtggccagcatgattaagattttatttgtagtgtaattccattataattaacattatgtaactgtagaaatatggtgtttgcacctcttcctggcagatgcttttaagtcagtggcagagaggagattaaatagtaaatgaagacctatttattgaaaattgtttctacatcctgtattgttggattcatttgtttgtttcacaaaccacagttaatttagtaaggaaaataagcaatatgtttaacaaacactcaaagtaaatttgtttgcagtgctttgaagtaccatagttgaacttttgatattagaagtaaagtattactgaaagatctgcaaattaagggtgtttaaatagtgaaaacaaaatgtttattttttccaaagattactaacagaatttaagtaaatgaaaataatatggttttgcatatggtttaaagcatttctagttacaagtgattttttttcaaaaataaattggccaaataattatgtatttaatttatatacattttgatcagactcctctagccaaggaattggcaatccatagcccactggccagatttgtttctcttcttcttttttgtgttgcccccaacctaaatgtggtttttacatttttagtagtggaaaaaatcaaaataataataatatttcattcacaataaaattatatagcatttaaatttcattgtccataaataaaactttattgggacacagtctcactcatttgtttaagtattggctgtttttacactacaacagtagaggtaagtagctctgagagtctgtatggcctgcaaggctgaaagtatatatcatctggccctttgtgaacaagtttgcagatctctctaccttagcaaataaacaaaacatcatcatcaacagtaatgataagactgtgataagggctttatatacattatttctaatgtatcaaatgatggtattatagacatattattatcttcatttatagatcagaagactgagggtctaatgattaactaatttccttactgagagctgagttttagttggaatatttatagcaacttgtaatatatatgaatgactattagagtttagacttatttaaaaacaacattgtgagtattttgagagtgagattttcttctataacccaattaatatttattaaataggattgggttgattgatttgatggtggttattctagaatatggaaatttggacatctcagttaatttagagctgcaaactaagagaaaatcagtgcttcattttgatgatagatgtcagaaccacttttctgcatccatatggatcttgtttgcttctgctgtatataagaatgattacaaattgctccaacttttattttgaggacgctaatgcattagccttgtagaattggcctatagggactttctctggaattccttgccattcattcatttattgtagaaaaaataagttggctaagatgatggttgttcatactaagagtatattgaaccaggtctgtgaaaggaattgagaagttatcgatgtatttcatcatttatctcattggaccacagtaaatgattattgcattaggatgtggtgataatgggttttgggtattattaaaaaataatttcaaaggaggtccaatatataatatacttagcctagctttaagagtggtagcagagggaaccactgtttccacatcagcttcctgaagtccagtgttaaaagattgattaaatgaaatctgttaggtaaaatgcatttcagttcataaaagtcatgaggcttcttgaataggcccttagaaaaatcaagactctaattatgcagtgctaaacattagaattacagccgaatattcatatagttacgtaagtatttgaaaatatctaatctaagacttccttagatatagctgaaagataatagtctagataatatcttgagggcagagcctctgtcttaaagtatcttcatgtttatatagtaaataaataagagtaagtattattattttaactaatatttactgagaactatgcaccagaaattgtgctaatttttgtaatcaatgcctcatttaattgtcctaaaacctgctgaataagtactaataattattaataatttattccaattttacagggtttacaggcccatatcaaacattcagattagttgagcttaacaatcaagtatctccagctccaaagcttaacaccttttccactatgctgtgttgtgtagcgtactccaaatgtttgatgagtgaatgcatgagaatgtgagggagttatcaggaaaccatcttcatcatggaattttaatctgttcttaacctaaagtttctctactctgaatgctgctactgtggtcatcattattaagctttattagagatccctactctatttacttgttttgaaaagataccatttctgagcaatcccagctgtgacttaagattgaacaaatcagctgtcacctgtcctacacagcagcgcattgacagcacaggtgtggtatttttgctccagtttggatgggttgccaacgatcaggttttccaaatgtgatttgtttagataaaactaaatattaataccacctcaagtgccatagtgtgtacaaccagaagagctctcatatataccttgcgtgattttcccagcaatacggttgttcagatagacaacaagaaacttgcagataagaagagggactcagaaggtttaggtgatttgtccaagtataccagctggaaactcaaactttctgatttcaacaccgtgctgggcattgcctcaatttgagaggggaaaatttggacccacataatgggattgcaccagccttcccatgcccagtgaagataggattgtaccaataatatgggttctttccttttagaaactaacttaatcactggaaccatcaaagcacccacgggtacatacaaaagaacacatgtcatatacctgtgtcatgaataataatgttatgtgtctgcactgtttaatagaaacatgatgtgagggatgggtgcggtggctcacatctgtaatcccagcattttggcaggctgaggcagatggattgcttgagcccaggagttcgagaccagcatgggcaacatagcaaaaaccctgtctttataaaaaaataccaaaattggcttgagcatggtggtgcacgcctctagtcccagttactcaggagactgaggtgacaggatcacttgagcccagggggttgaggctgctatgagccatgatcatgccactgcactccagcctgggcgacaaagcgagactctgtttcaaaaaaacaaaacaaaacaaaagaaatatgatgtgaatcaaaaatataatttaaacttttttggtattcacaccaaaaagtaaaatgaaacaggtgaaatttactttaataaatcattttagttaacacaatatgtcaaaaaatattatcattcaactgtaccaatattaaaacaattaccaattagatactttacactcattttttgctctaaatcttcaattcatactagccacattgcaaatactcaatagtcacatctggctagtggtggttaccaagtaggacagcttggctctgaatagcatgatagtacagttgccatgcttaggcatggagatgctcagagaagaggactgggaggaaatttccctaatccatccccttaactcccccacattttgtcattcagatgatctcctttttgtttaaatgtaaatgtctttttatatttttaacctaactggctattcatctcactgatattcaatcatctgataaagagcttctattctcaagagttctctgaggaagcagtacatctatgcaaggaaatacataaacatgactccagtgattggaacaaaattagaagatttctgaggaaaaattgctgctataatttaagaaatgtaccttagcaacatccaaggctcacgagaatcaaattggttattttgggttaaagtcaaataaaagcactttttcttcacatatttttctttttgtcatttatctaaaacgaatggttgataatgattaaaatgtaattttactatagaatgagaagaaaaagccagaaaatatttgaagtactcttcaatttatttaatcaattatgtcctgataaaaatatgctaattgcaattcagattgcaaggattttggtattttttcttagccttttaggtatttattaacacaatacaacacattcctatgaaattaacatataggattatacctgaattatatatttctataaagaattttccctaaatgacaaagcttaccagagagcatttaaataacatgttttagatatagatatatatagtgcacacatgtacttttcttaaaccttcgtgaatatgactctcttctgagacctgtctgaaattttatatttcctaaaatgacttgatcacatcatcatcgtcatccaataataataataaaaacaatgacctgaaccagaaattgtgcttatttttacagtcaatgcctcatttaaatgtctaaagcctgctaaataattagtataattattaataattgattccaattttacagggtttacagggccatgtaaaacattcagagtagttgaacttaacagtcaagtatctctagctgcaaagcttaagatcttttccactatactgtgttgtatagcatactccaaatgtttgatgagtgaatgcatgagaacaactgttaagatttatcaatgcttattaatactagtacaatgcaagtttttttaatactctttacatgccttatctcattttatctttacagcaaccctattttggtagctattctgaccaataacaggctgtctaaaaactatatagctaaaaattggtatgctgtttttagttttttataaatattgctaaataactccatagagtttgtactaatgaaggcactcaccaaaaatgtatgtgaatgtctattaccccaggcatttatcaacagtgtaacacttttgatctttgccaactcaatagacgaaaacattgagtgaaaatatatttgttttcatttgcattttttaattataattgagatcaagtttttttcttagctcttatcactctctacctctacataatggcttgatcaagggattaacaagctctaaatgagatgactttattatgagtgggaagtcataagaaaggttgagtggaaagaagagacagaggaggtttttgacccaggaagacagattctacttttatgaatagtccctattctcttctctgaaatgaatcgagcacttctgatagaaatctgagtgcatgcaaagaaattggttaatggggcgcctgttaagagcagtcaaactattcaagcatggctagctgctgtggctgctatgattatatttttaaactaatgggggtcagactgaactgtcttgagctatgacagttattaaacatatacccacagaaaccccaaagagaagctaataattgatggccttttatttttacataccagattcttcactgatccctgtctgaaatccactgttgactcttcactcaataaaatcatatgaatattgagtattttaatgtcagtagatggcattctccactggaaacacacttcataactccaccgtatggcctctacataacctcttaagtggtcgatcaagaagcctttgcctgtttttgtttttcgcagtcttgtgatatattctgcattctccgttagggctatatgcattgattagcatatagatggctattctgaactaggccaatactattcagcatgtactacttaatttaggaataatagtatttatgtaaggattatttccagtgaaccaggataggcatagatggtttgagaaatcaaatctgttgagaatcttcagaccgttttcttggtgctaatttcagtgtccaccccctcacccccaattgaaccgtttaacaaagcagccgtataatagaatcatcctagatcatagttattatctgttgcagggacatgaaggtcatctagcttactcctctaattttgtggatgaagaagttcattataataagtaaagacttttctaagaaagtcaatggaaaagtcgggactccctaatttgagcccagtgaattttcctttctcagaattatccatgcccttttaaaatacgaagtgaaatacacagcaaaaggtagaagaaaatcaaacaaaaaaatcacctggaaaatctactttatgcaattagtattggtaatgcttcttcacgattccagcaatgccatataattcctttctctgttaggtatctagtaatttttccttgttttcagctgataatttgtctggtagattctgaaatggcaacctgccatttgacaagaaaaccagtaatggatatgcatttaagaaattttcttgggaggccaaggcgagtggatcacttgaggtcaggagttcgagagtagcctgaccaatatggtgaaaccccgtctctactaaaaacacaaaattagctgggcatggtaacgcacacctgtaatcccagctacttgggaggctgaggcaggagaatcacttgaacccaggaggaggaggttgcagtgagaaaagatcgcaccattgcactccagccggggcaacaagtccatctcaaaaaaaaaaaaaaaaaaaaagaggaagttttcattgcgtctggctaagacttacaaacttcatcagcttgtggagttagtctctgctcatctcatttatatacagagctacttatctgatttgactttattcctgacactggaccaagaaattgttgatggggatttatgctgctgattctattaagaaaattcattaaatgcccttttatgaaactagcaggattgggtacaatacctaacattaggaaaaagtcaaataattttctttagcatgaggcagatgcattgttgattgcctttgtcataaagaaattttatttgaatctttatcagcgactccaaaataagcttgatcattttatgagtgtgatcgtcacaaagagcatatttctcttttacttttttctcttctctttttctcttgtttaagaagtagcaccaatttctttgccagaggaacatgtgattgtattttcagtattttctcactcacaaaagattcaagtttatgctaactggagaccagaaacttgtctttcttgttgcttgaagctttgacaaaatctgtttacttgctttgaacagtattgccctgagtttatttttttggggaaaaaaaggccatacttggaaaaattgagttcttatttatcttggcttatctgttgtatagataacatctgctgtctcagagcttactcagaactaacaaaagaaccaagtggcagagaacacccgtaagtttatacatttcagagacaaaaaggatttatttttgcctgttctatttgtcttttgactacagtttgaaatgagtgattattgtgaatagtttgagatgtaatgatgccaacattatcaatttgtacatttatcaaggttatgcatactaggattatgcatgctatgataacctaaaaactatttaggttaagcagcttattaatatccaagttaactttgatacagttacaaacacagaacctcaaatatctatccaggaaaggaatatcttagcctgtttttcaacatgctacagtaaatatttaatatttaaaaattttgacatttaacacattcagtatctttttattttcctcccctttttctaataattcctataattgtttttataaatttttgaactcttctctctgcttaaaataaaatttctccccaatgcaaattgtgttgtctgttaactgtttagtaagaggagctttgctatcctatatgatgaacacttgattatgtattttgattaatggttactatgccaactagagaactagatttcagtaaaatgatcccactagattgtaaattttgttaatttagaagtaacaagagcatctagtattatgcttattcttgggctaattcatttctttactatcatttattttatattaactcatttatttattgttacaatacatccacttaacacccaggttttcaatggccactctgaaagaggcattgttctaagtgctggaatacaaatacgaggcattatcttgcttcagtacacatacaatgtagttgaaggaaagatttcagtaaactagtcaaaaaatttagtgcaagtagaaatgttattataggagatacagcagtgggccatcttaattcaatggagaagggttcaggaaattgaggttggtcaagttgagttttgagggatgttaagtaagtgcttctttagatataaggtactataagttgtacacattattatgaaagcactgtgtagcagcaacataatcataatcattatgaagttacaggatagtctcattgggagcagttgttaagtttacatcctctaggtcattgctaaaactcggtaatttggcaggaagtacgtaggagctgaagataggagaatccactctgctgattagcaatgaaaccacaggccacccactgaacctctcttactttacttccttatctgtgaactgggataataccattaggtgctcatttaatgtcatttaatgcttgatataaagtctaaatgacgtcatgtgtgtggaagcatattgtaaattgaaaagccctataaagtgaaactgactttattctatacatatttattcacacctgctgtgttcaattcattgaactacatgtgaagagtaaatagttttgttttgttttagtcttcaggaagcagtgagcatttttaaaaggtcgttattgaacccagtactttttgtttggaggctcaggaataatgttaattatttcccttgggaatgcaacacaagccatgtctgtgtccaaatgggacattaaaaaagcatgtcctcaaactatcatttttatttattcactttaatttcactcactaatacctattggatgtcaggctctgcactagacatcaggatgccactctcatttggtgggcagttaaggctgcagtcacaaatcacacatcataaaagagagggagatagcaagggagatcacatatcaagtagggagatagaatgagtaggcagaagacggttaagagagatcgtgccagaagaaagggtatgaaatgggaaggaacatggcacattttaagaactgaaacttcttcagtgtagctggactgcagagagcaagatggaggatggtagaagatgagatggtgggaatatttggcaaagaccagacagtgcagggatttgtaggccaattgaagaattttggccttttctctatgagtaatgggaagacagtgaagcatcttaagagggttgaggtaagagggacgatcatactagctactaaagtttgtggagtcagtagtggtaggttgtggggaggtggtggtgaagatgaagagatgtgaatgaagtaaaatggtcttgacttagtggtggattggctatataggagggatgagagggaggcagaatatcacattgaatttaaatttagaaaggtttactgtaagctgggtgtggttactcctgtttgtagtcccagaaactccagaggctgaagcagtaggatcgcttgaggccaagagttgaagctgcagtgagctataacccaccactgcactccagactcagcgacagagcaagacactgtctcaaaaacaaaaacaaaaggaaaagcgaaaagggagaaaggtttagtgtaaaatctttgagagtaaaaagagagagggatttctaaatcttggattgtgcttatgccatttaaaagctttataattgttgtgcaccttctctaacttatttaatataaccttcttgaaggttagatttcaggttttaaaaaatattttatttctggtctaaaaatttggcagggattttaaagaaatggtaagtgataagaagggagttgttttcatttagtttgtaaggaatgaatattggtatttttatgatctgatgaaatttatcctttaatttcaagtgagacagtttgactttcatatgaagattaaataattaattttgcttacttcagatattcagatttaaattagcctataggccattattaaaatagatttactgtgataattttcttgctcatcagggtaacttattaaacagattataaaatatcataataaaatcaggtcctctgtaaatccagtgaagaacgttttttaacatgacttgccattgagacgtttttataaaaccagtgatacccctggaaagtaattgactaaagaaaaaaaaaagtccaggtttattcctcattgtaaaattcactttttaaatttgcaggctatgaacaattgaatttgaggaataacgtattttgggatatgtaccattttatttaaataagtaaataattatatggtgaaggaataataaatatgtattatcttctaggaattgtataacagttttgattactgattttgacgggactacttttccttatgaattatggaatatatagctaaatcttatataaacaatatataatgcaacagcaatatattttctattaaactataaaatagtaggttaattttaacatcagatttagtccaaaatttatttgccaataaaatgaataatagaaaatttttaatcataaaatttcatttgctgatgtataataaaattgtagatttttcaaaataaaaaaatcttagaaaatatcttaaatttgttatctgaattgctaaatacaatcttcaatgtatttaatgctttcccttcagctatttatttggctttaaatatttggtgatttttaataaaatgtatgtattttgctatgttaaaaatccgaatgttgccaaactgtgcgttttggaacctaacttactcctgtaaaaatgattttatgtgttgtcatttttaattatcagttggctctgtgttttttttttgagacggagtctggccctgtcgcccaggctggagtgcggtggcgccatctcggctcactgcaagctccgcctcccgggttcccgccattctcccgcctcagcctcccgagtagctgggactacaggcgccgccaccacgcctggctaatttttgtatttttagtagagacggggtttcaccgtgttagccaggatggtctcgatctcctgacctcgtgatccgcccgcctcggcctcccaaagtgctgggatgacaggcgtgagccaccgtgcccggcctggctctgtttttattagaaaaattctcaatcgtcgtcttttaagtgagtcaacctaataccttttaattttgtgcaaagttctctgttttaataacttttaatttagtgcatatatcatatactggagaattatcaatttatttgattcttttagcaatttatattttggtaattctgtgttaataatgtgatttgtatttggttacgcagttgccgataatcctgtggcattacagagtttgatttatgcggacgatccttggacttaaaaaggattactgaccatttaagaaagattaattaatgagtataacattgagtcctaactctgctaatgcttgtctaagctacacacagatacatgcacagacacacataccctcaaatctcataccaaaaatgaccaaattacaacaaaggggatagtatcctatcctgctaggccatcacattatggatcagcagtgtagagcaagtcttgtggggcctgatcttgctcttacaagctttgggatcttgggcaattcagtttccctaagctcagttccttatttatagtcagtgagatgaatcctatggtctcttaggttccttttatttcgtaattcaaaaagttgaagttagaggttaataattttgtattggtaagactgcaatagcagtcttcttcttataattaataaattaagaagttacagggaccaagggagaaaggtaaattcatttatagggataagacaataaaagggtacaattaatttatttggtcaccagtgttcttgttttcttgctgaattttatgggatgggaacagatctaggaaggaaggctcgtctgtacccttttgccctacctgacgtaaaactcaggactgacccatcctaaaatcattcatttagaaagaatccctcataaccatgttagctcaaggttatcttgtatctgatttctctcttcctgcataggttgcagactgaagagcattaaaatatctgttttcttagtggttttcctttctggatttgaataattcacttgattcttccaggctacttaaatgaaagagtgttatctaagaatgctaatcttagttccttttgtttgagattagagaaatcaatgcattatatttttagtctagatagtaagtcctgaatgccctttactctggccatttaaaaaactaaattattttcagttggctttcatattgtggggttagatattcatttgagatatgttttcttttttccttttccgttcctttagttaaaacgaaatcttaccctaaagtgggataataaggggaaagatccattgaatttgagtattgggcttagtttgcattaaatgctccttttgttcctgtttatgtattattttaagctcgtttttccaaatataccaacagcagatatcaaatgaccattacttcatactagaaggaatttttataaaccaggccaaagacttcactagatttctcaaactttgtttctaactctgaaatcctatgattttatgatttttaatatattagagtaaacctacaaaattgtaattttgtaggtgaacaatagttagacagtgtcggtttcatatgattcaacctacatatggaagcttagtcattgcattgtttaggaaaactatgtaactcatgtatgaaaatggtaatgtcaagcaacgaagcttattaagacactaacatcatttttaaaatttagttttgaatactagatattaaaaattatattttaaacgtttgtaaatccagtgagaataaaatgttctttgcatatcttatttcttttcacagggagttttttcctgtgttttatgagaaaaatcacaggcattacagtttgaaatcaatttcattgttttcattgcaattgctacatagctgttgaatatttgtagtaaggtttaatgactaatgaagtgcatgcttgattatatgccattagtaaaaatatatttttatggcaaagggcggtttgcagcatggcattgacaaaagcaatatgtaaatgtgttactccccttcaaaagaatgcaaatcagtataaacaaattttaaggaaaatatttaaaaataaacaattaaaataatggatatttattgtttgttacttattgagatgatatgaatatgtaaatagagcacttaggtctacttattttcagaggccagtgtactactaattagaaaagttgtagatatcataattactgtagtaaattaatttgtctttattgcttacattttattgcttggtattccaggcattggatagatagttacaatgctgacatcaagagtgttcccacgattatttctccgcttttctaatcatcaactcattatatgtcccttatcctcctgctacttattatcacttgccatttcactcattatttgctcctatctctctgtctttgctcattcaattctcttttctagggataccccttccttccagttcttacctgccaaagctgtgtttggcttctaatgtttagcttaatgtctgcatcttctgcaatgtctttcagatgtctgcagtcagaactctttactcaaggtcactaccgtcagcttgtctttccactggagctcatccagaacacattgctttgtgaccaaacacattctctctgtatctgcctcccaattagactgtgtacttctcttccccatgttccctcctttgacacaagtcatgctcttctaagcaatccaggcttgttcagttgaattattttctaaaattaaaacggtatgccagacaaggtaatacaagtctaggcttgatttttcctgagtgttgtgtttgcggtgggtgggccaattatttctgttccttttcaaaggatctcacttatcttcttgttttctgccccattggataaatcatctcatgtcatcatttatttaacttcaaacacaatttctaaatgttgaggaatacgagaacaaaaagagcatgtctgcatctgcatacatggtcttaggtattgggtgaaagaccatcaaaaacttatattagtactaggaagaacacaattattttaaaatacattaaatgcataataacttttaaaattaagggtcaggaagaaatctctaatagaaatcacaaaacgatagacattttctttgaccattcttgctttgcttctctaatgtatatttaatattaatataaataacagcagtaatgacaaccataatggccactaccatgtcatagaatgtactatatgcattcacgtgtttcatctgatttggtccacatatcataacatgaagttggtgaggctgaggctatatatgttattcagactcaagatagaaaggattcattaggaaagggttcatgagaaaaataagcttaaagcacaatgttttcttccaactttccatttcaggggtacatatgcaggatgtgcaggtttgttacataggtaaatgtgaagcagagacacttttttaacatcagttctccagtgagttcatagcagattacagggtcaaaatatatatgcatacaccatagtaagcaccatttaaacttgtagaagtaagaaaattgtccttgaatagtcagttcaatcttcctgtgctctattgagtgtatctatctgtggatacaaaatgaataaagatggatctggacatttcacccttccgcatatgggagtaaaacctataaggagactaataatatcatgcatcacaaattacttgctgcagttaaagaagttttattcagatcctcatgatctcacagggatccagtatcttgagagttgacgaactttccataaaaacactaatcacgtataacagttcagtcaaaatctactgatatagatattccaaagtatggcaggaatttagaacaaaagatggaaaatttgaaggctctgatctgtaacatttcttcttaaaatatttcagctgacttgcttagcctggtatgcagaatctggtgcaagctgagcacggtctaagttgcctcatcatctcagctctccatgcttctgtatttgtatacttccatacttagcaagtaactgttctccctccatggaatgtattattatcctctgccactgtcctcttaaacctggcaaatgcataactttcttttgagacctacctttgttaagacctagctctttgaagacttccctgattgtccaaggtaatgttgactttactttgtaactgtatgtatttttcttatgtcagcaaccactgctctgggttattactatatttttctctcccaaataagacaagaggttctgttagaagtggaaccttaatatccatttttatgtgatgaatttctaggcccatgtgtgggctgtattaaaggattaaagcaagcttgttcaacctgtggcccaggacagcttttattgtggcctgagacaaattcgtaaactttcttaaaacattatgagattgttttgtgatttttttttagctcaccagctatcattagtgtattttatgtatggcccaagacaactcttcttcccatgtggcccagggaagccaaaagactggacacccttgggtgaaagcttattagtaatgagtaaataaacaaaatggagtggatgaatagtgtagttcactatggacaagttaaataatgcttttctcaatgataagggcaaaatgaaaattctgagatttctacatgcattatccttgaaacctttagtattttacatgtagagaggtcattgttcagactcgcatttgatagagtaatcagtgttgaagacattcccaatggtgtaagttgccatacttctgcagtataggctggttgcccacaggaaaatattggagacaaagctgaaagcaatgtaaaaaccttgtgaaaaagcagaatgtatctttgaagaactgcacttaatatgttattcagcctaatttgtgcattttaagtaacatgttgatgagttgtacggtagttttcctttatccatagcccataccacaactccaagtagatgcctgcagatggtactgaacccttatatatactatgtttttcctgtgcatacatacctatgataaagtttaatttataaattaggcacagtaagaaattaataactattgataaaatagaacagttataacatcatactgtaataaaaaaaatctatgtaaatgtggtttctctctctgtgtgtctctctgtcatctcaaaatatcttattatactgtactcacctatttttggactgtgggtgaccacaggtaactgaagctgtggaaagcaaaaccatgaataagtggggactgctgtatgtgttgtagagctgtgctgtccagtctgtcagccactacttacatgtggctactgggaaatggaaatgtgtgcccaaagtgatatgtgctgtaagtgaaaaatgaacattaggtttcagaagataagtacaaaaaaaggaatatgaactatttcactattgtttctctgttgaaatgatattttgagtatattaggttacataaaatatattattaaacttaattttatccctatctctttactttttaactgttactgctagaaaatttcaaactgcatatgtgtcttgcattatatttccattggacagtcctggaaaggaaattatgattatccagagaataaagtcattaaataaaaggaaaggttaaataaagtatgacccgtcaggagagagacaaacaaggagagggaacagggtaagtcagccaagcatggaaacatgtggcgattgctcaagggcttgtgctctgaatctgaaaatgctgtaatggtctatgaaaatacttttagagctagtaaatgaaaataagtgcttatataacatataaacttaaaaaattcatgatatttaatgttcaataactatgagaaggcttaatcaacctactgtaatattttaattaaaaatcattctaacgtcaaataaacggagaaatactgtccgtcttccataatagatacaatggatggtttaatgttaaataccctgagaagtcttacagctaaaaatttatcactgtttcaaacagaattgttcccatatctggatgatagaactcactcctcctatgtatttaataatcagtattctatgagatatattttgggagatacttagtagaagataaagtcactgtattttattagggatgaaactgaggctagggagatccctaattcatttgagatctaatatgtgggcaaaatagacagattggtgcaatatccagcacagtttaacaaacactttccgagtagctactttgtgccagttattcattctggcaataagacgaataatacagccaggttggtgaatatcacaattcatagattctcaggtgattgttctcatgttttcagaaaaaggcaatgacagtgtgtacactgacccagagggtgattgtcctgctatacttaattttccaataactcctattgcattgaaactgttgcaactattcttcagaagtatagacattgaaataagtaaaataaaatagtaacgtacattgagttttagaaatgtaccatgtacatgtttttagaactcttagcattttgatttaaaataataaaaattggtgtacgtattttcttttgtagacaaaagattgtagggtgaaaatttgtaaatttaacctaatattttattctcattggtcacatgttatgaaaaattatatacctttcagctacctgtaactatgtcttctatgagtaatcatgaactgtctagctctgctgaagtttttatatttttcatgaattcgtacttaaatcctagcactagagttccttttttgagaattattccttttctctcagctcttctttcaactttaccagcaacaggcacacagagagatacatctgtgtgcacacatgcgtgctctaccttacactctcacattctcacactgtcagatgctcttagataaatacctttctggatgttagtttttcagaatgtcagtggtcccaattattttcctcaggtacagattaaaattttaaccctacattctctgataggtttctgtttaatagcactgatgtgtttttttaaaaaaaatatcatacaatgcaattgcatattttggacattctcatcctgcaactactttccctccccaaaatgtttagattctgtggctgagatacagtaaagtgcacaaaatcatgcaatcatttacttattcattcagcaaattgtcatcaaggcaatgggctagcaattgtggggataataaggaaagcatttttaataccccttatcctgaaaggaaacctttaatgggaagatatttttgctatcatattacatttttttgagtaataaaattgctgtgtttaacatttgccttaagtaacttccatagatagttactttcatgctggcccatagctgtgctggggatagtggtaggcacatctttaactcgggaattagtttgaagttgcagaattgttagtaaatgtagtatttgttgatttattacacatattggcagcaatgcaatgtgtatatactattataggaaataccaagaaaaataaaaattaaaagacaaacagcttataataattacccacaaagggctttttaccatgaaaaggagagaggggatggtgggttcaaacaaattgttctaatagaagatgagttcctaaaagaggcatagatgaagtttgatggggcattcagaggtggggaaaagtcctctcagggggattcagggaatgttcgtggaatgagttggcagtggatttgttcagtgtaatgtggctgcgatttggacatacagacttggtggagatgttcactgcaagttgagtaagtagtgcaaacatacacatagagacaagaaaagtcttagggcgtggatgtgaacagcaactggaggaggttggttaagtacaagcatagaatgggaaatgaatgtgaatgccatgcacaaagcacatatgcattgtgttctactatatatttacacaggtgccttttctttctctggaagggagatttgcatggatgcctttctaggtggatgtcatacccagcgaattctgttgataagctattgccgttgcagtgactgcaataattcttgagcatgccatctttaccagctctgctagagtgttgaatgttcaaaagaaaaacccaagtacctattaaatcatcagatgccatagtgtgtttataaaatcagatgaaagccaatttctgtattagagcagatctacttttctgtgcttggttggtgttgtaaggagagattattctgcttccctaagaaggttaagctgtcatctagttaaatatggacttaaaataatgctgccaaagcagttgcctcttgtgattgatgatgatgatgacagatgatgatagttttgaaatcagttttacagggaaaattgctatttttctactttggctgatgttgtagttctagatttgcgaatttcttgtcatattcgggaacatttttgattaaaaggaaaattgctaaggactgtattcttgatgataaaatggctctaaaactgagctatggggcaaatgattataagttgacttatacatattatttgagcgacagcagttattcttggctttacagtgtcattatgagttatattttggggaacaaatagcaacccatgtctagtcagcaaaagtggcagaaagtgtggtacttagaagttatgataataatagtgtcttactaaagtcatcaaagaactttcgtatgtattactattaaattttctctacaattctctcaggacttcatgcatgtgtttcctctccttgaattgtttttcccctcagatacctacatggcttgttttctttctctagaagaatagccgcaccctctctgcagtctctcattcctccatggcatttatcaccacctgacatgtgatatatgtatttgtttactatctcctcatgctaggttgtaagccgtgtgaatgctgagactggtttcttcagtgcaataaagtaagaacctataaaagttcctggctcataataggtactcagttagtaattcttgaatcattagctctatgaataaatctttattttatacatagacgactgaatattgtggtcatgatataaaaagaagctaatgtttggtgccagaatcaaattcaagcttttcagtttatttaaccaaattgctttggtttgtgtctatgtaagtaacatagacaacaaatagccctgaaaaaaaggagtaatagtgaagacttactcttaggtgtgaaccatttctgtacctcatcacattctagaatcaatcaatcaattttgtttatacagaattgctggtaatggctactctataccactgcattgtgtgagcctgtgcagacactggtctgaaaaagccattttcaggaaggaaaagaaaacagaacataaaccccccaaatattttttaaaggccaataacatttgtatccattgggtaaacacgatcaatcaaagctctacaagccttctatgggttgcttccttaacaaatatgttttttgccttggccattcatcatatctggaagtttgggtgatgagcttgagcactctcttccgttaatactgaaaatagccacttagtggctttgtgaaaagaaaagcctgttaaagcgacagaacaaacatgcattctcctgacgatataaaacaggatattgtagattgtttatattcgtgtgggcttggtgtaatgaaattcagctgaattttaagaagaggatttgttttaatgggaaattaggttgtgaatggaaaaggctacaatgcagatacgaaaggtattccctcgtaccctccaaacgcataaggagttttctaatgagactgagagtagtagctgctaaaagcaaagtcatcttatctgttgtctgagatgaattaccttaaaaaattgtaccctgacctcattactatacattacatatattgaaacatcactatgtatctcctgatatgcataattattatttgtcaattaaagaaaataaaataaattataaaaaaacattgtagatgggcttaaaaagtgaagaaataggtagcttctgtcaccagcactatttagagggattgatgaactattttgagaaggttggggctgggagaggagtactatgaaaaatgaaaagtcacatctctggaagcaggcatgtagtatcacatccaaaggacactgtacatacaaggtctactgcagtcagagagattaaaataatcttccgacctctgaaataggataatacaccaattataagtgatctcatgactagaaagtgtactttttttccaggacagttagtgtgtctgaaagtgagcagctagaaagttcaaggaggcagactcacttatttttggttatagaatgggtagggtttgggccaaataatctagcttgtagagtcaagtttagtcatttgttgaggtttacaggaagcacaaagagagaagagtagttgaaacagcataggttgggcaaagaattaaatggtgggataaaatgggtcttggtaaaacatgtaaatgagattaaatgagctggaaagaaatcaaccaaacaaatttcaaatgctgaaggtaatagagtgggtaatggttgtcccattatgtggtggctttagttttcagtcctagtaccacaatgccccttgccatagaccttttctttaaaacaaacaaggaatattcttatgccttattttctacataatgagtgtttttattgattttagatttttttcaagatccctatagagggattttgaatacttttcatttcctgctttaaccaggatgtctgccagaaatggatgtaaagcagtgcatggattttaaaataagaaagctcttagaatttccttatccatttccagtgctttgtgcattgctccaaaatattgctgttttcagtatgggttttgggtctcatatagagaagatggctcatttgatcgaataacatttcatataattgccctttataatttaacttttctatgtaaaatcatattcacttctgtgtgatcaattacaaatataaagatttaatttcatgagaattactgctccttcaattaatagactagagaagaagagattctacattttcccttaaatggcataactaattaatagcgaaatgtgactagaacccagattttctgaatcatggactcagtgttgtttctcctacgaagagcagatagagtacttgtagttaaacaaaattagattaaaatttcagctatcaaccctattagcaagttatttatgctgtaagcctcttattttttaatctataaaatgaagttaataatagcatttctatagcattgtaggatgactgtagttgataatatatagctagagggaggatattgaatattcccaacacaatgaaatgataaatgttcaggacgatgcatatgataattaccctgatctgatcacattacatgtatggaaacatcactatgtgggaaataaccaaactgttttggaacccttgctcatgaaggaatttgcattttgtcacactatttgcatgttcatttggttttggactgcattatgcatatttaaaacatactaaatgttatccctcaaagaatgtgtaatcttaacagtcctgagtgaagacaaaagtagacagtgatcgtggaatccagaacatactatccaatgatcaatataatacctagtaatttaaaatagagccttttactgattttgctctagttctagttaatgaagaaaagaagagatcattttaaaggaataattagtaaagacacctgcaaattttatgcataagtctgagtaagagaaattctgctgataatgctaatattatattgtcacctatatatatagtgtcatatctaaatattttaaaaataccaaataagaatatcctgctttttactatagaaaagaagctaatggaaaaccgatcatctgaccaattattaaaatgcatcctctctcctataagctctgttgttaatttcgtgatacaccttgaatatgccacaagcaattggtaatagcatcaattaacatttgggaagttcagcatggccacctaagatattaaatatttgctacaggaatgctaatgaaatccactgatgttatattcccaaggtattgtttaccaataacagcaaagctaagggttaccaaataaatgaaggaagatctacttagagctgttttcttcaattattctaatttttgtgttctcattttggttctgagttttctcacctgcatttgaggtcagagtctggaaacagggctttcagggatgcatcactaatgtcctttaggaaatatgtctttgcataatcaacgtcattgaggagacttttataagaaaatgaaaaaaagaatgaatttgactttcccttcactttttttttgtagagccattgccgtttctgtatttggataggagagaaatgaagcattgttatttaatttagcccttattataacatattatgtagtctcttagggtggcatgttaccaaaaacaagatgttctattttaaaagttgatttagtattacttcttttttttaattcacaatacattatgtaggtaggtttttttttctgtacattacacaccacagactgtattagaaaataatgttggtgtagttttattgaagccacatcatgaaacataagtattataaagagaaggctgttttcccatttcaatcagttgtctagttgatgtgtttatttttcatccaatttattttatatactaaaaaacagctcttaggaaagtgagtacatcaaactcagtttcattgatttaattttatttattttactttaggctaagttaattcaaatcaatagcgtgtatgtatttcagtgtaacctgtgatgatttctgctcaaactctacattcacatttataggaatcaggatattgccagatacgcactgatttaatgaatgaagacattgcagatattagaaacaacagtctctaatgaaataattgaatttatttttccctccaacatagttgagtggtgaaactatactcttgataaagttttttattataatgtattaagtacagtggtaaataaaatggacttcattttcaaatggatcttcagcaaaacattaggtttttaaatcacctttattacatttttatgtatctctttttgggatcttattgctttattagtatataacgtttttgatatttctaaacatgtttccaaaaatctgaatttacacattgataaaaataaaaacgacttagtcttctctgtcactgtgttctttttgcacttccattgactatgttccattcatgaataagaaaaagaaaaaaattagaagagatttattggaaagcaaaggtaactcttactactatttcatagaccatctctttgattttgcaggttagtttgtcctgtctgggggagataaaatgtagatttaatatggctaatgatttagaatcctgtctactatgaaacttaactcacacactaagaaaggtgatataaatgctgaatccctttaagtacatcttggcttgatgatgatatttgatgatccactgatttgtcttccaaaacactgtaacatttggttctttctgaaatcatcaatattattgttgtcgaaagacttcagaaagccagattgtctcccaaattgtttaatacttctttgctttttggtacgttttcttatttagttattaaataagttcttagtctttaaagctgatttttaatttttttgtcttttagggactactatattcacaaaagaataccagtaatacatgcacagcacaatgaaaaaaaccaatatgaagtagttgtttgattagtttcagcaatataaatggccactgcaagtagtttaggagccaaagagcattcctgcaatctagaattagtagtttcatttttttttcaattgaattgaaattggtcaaggtaactagataatgctaaatccccagtctactttgtgccgtgtagttattctaatcgtattgaagaacgttgtccatttgtcagcattttacaaagtgtgttaatgacttctattcctgctaccttatttttctgcccattagaataaacagtgactttatgtcacataaaagtagccttatagcctttttaaacgtttatttttgacaggagttgatggtatggtatttatgagagctgagaccagaattaaaaagttgtaacacattgttttagtgaacgaaacaaaagaacaaatattctgccacacgatttataccataattctagaatttactttatccttttataaattcaacagctaaaaaggtctactgactaatttttcttaattaaattattttcttgaaacagaatataagttcctgctactactactactaatctcatctttattggaatcagttaggtcatattgagccatgattactttttcatttttttttttttattgagacagagtcgcactctgtcacccaggctggagggcagtggtgccatctcggctcactgcagccttaacctcctggactcgatctatcctcccgcctcagcctttgaaattgctggtattactggcatgagccaccacacctggtcaagatttcttattaatttaacattttcaactatttctgcatagttgatatgtgtcctattgctttctgatttttttttaatttgttctttttggttattatactttaagttctgggatacatgtgcagaacatgcaggtttgttacataggtatacacgtgccatgttggcgtgctgcagccatcaacccataatctacattgggtatttctcctaatgctatccctcccctagccccccacccccctacaggccccagtatgtgatgttcccctccctgtgtccatgtgttcttatagttcaactcccacttatgagtgagaacatgcggtgttgggttttctgttcctgttttagtttgctgagaatgatggtttccagcttcatccatgtccctgcaaaggacatgaactcatccttttttaatggctgcatagtattccatggtgtatatgtgccacatattctttatccagtctgtcattgatgggcatacgggttggttccaagtctttgttattgtgaacagtgctgcagtaaacatacatgcgcatgtgtcattatagtagaataatgtataatcctttgggtatatacccagtaatgggattattgggtcaaatggtatttctggttatagatccttgaggaattgccacactgtcttccacagtggttgaactaatttacactcccactaacagtgtaaaagcattcctatttctccacatcctctccggcatttgttgtttcctgactttttaatgatctccaatctaactggcgtgagatggtatctcattgtggttttgatttgcattctctaatgaccagggatgatgagcgttttttcatatgtttcttggctgcataaatgtcttcttttgagaagtgtctgttcatatcatttgcccactttttgatggggttgtttttttcttgtaaatttctttaaattccttgtatattctggatattagccctttgtcagatggtggattacaaaaattttctctcattctataggttgccttttcactctgatgatagtttcttttgctgtgaggaagctctttagtttaattagatcccatttgtccatcttggcttttgttgccgttggttttggtgttttagtcatgaagtctttgcccatgcctatgtcctaaatggtattgcctaggctttcttctgtggtttttatagttttaggtcttaggtttaagtgtttaatccagcttgagttaatttttgtataaggtgtaaggaagggctccagtttcagttttctgcttacggctagccagttttcccaacaccatttattaagtagggaatcctttctccattgcttgtttttgtcaggttagtcaaagttcagctgggtgtagatgtgtggcattatttctgagggctctgtcctgttccattggtctatatatctgttttggtaccagtaccgtgctggatttataaagcaagttcttggagacctacaaagagacttagactcttacacagtaatagtgtgagactttaacaccccactgtcaatattagacagatcaatgagacagaaaattaacaaggatatttaggacttgaactcagctctgaaccatgtggatctaatagacatccacagaactctccaccccaaatccacagaatatacatttttctcagcaccacatcgcacttaattattggaagtaaactctaataattggaagtaaaactctactcagcaaatgcaaaagaacagaaatatgacaaacagtctctcagaccacagtgcaatcaaattagaactcaggattaagaaactcactcaaaaccgcacaactacatggaaactgaacaacctgctgctgaatgactactgggtaaataacgaaattaaggcagaaataaataagttctttgaaaccaaggggaacaaagacacttatgtaccagaatttctgggacgcatttaaagcaatgtttagagggaaatctatagcactaagtgcctgcaagagaaaacaggaaagatctaaaattgacagtctaacatcacagttaaaagaaccagagaagcaaaagcaaacaaattcaaaagctagcagaatacaagaaacaactaagatcagagcagaactgaaggagatagagacatgaaaaacccttaaaaaaaatcaatgaatccaggagctggttttttgaaaagattagcaaaatagatagactgctagccagactaataaagaagaaaagagagaagaatcaactagacagaataaaaaatgataaaggggatatcaccactgatcccatagaaatgcatactaccatcagagaatcctataaacacctctatgcaaataaacgagaaaatctggaagaaatgtataaattcctggacacatacaccctcccaagactaaaccaggaagaagtcaaatctctgaatagaccaataacaagttctgaaattgaggcactaattaatagtctaccaaccaaaaaaagtccaggaccagatggatttacagccgaattctaccagaggtacaaagaggaactggtatcattccttctgaaactattccaaacaatagaaaaagagggaatcctccctaactcattttgtgaggtcagcatcatcctgataccaaaacctggcagagacacaacaaaaaaagaaaatttcaggtcagtatccctgatgagcatcgttgcaaaaatcatcagtaaaatactggcaaaccgaatccagcagcacatcaaaaatcttatccaccatgatcaagtcatcttcatcactgggatgcaaggctggttcaacatacacaaaccaataggcagagagccaaatcatgagtgaactcccattcacaattgctatgaagagaataaaatacctaggaatacaacttaaaagggatgtgaaggacctcttcaaggagaactacaaaccactgctcaaggaaataacagaggacacaaacaaatggaaaagcattctatgctcatggataggaagaatcaatatcatgaaaatggccataaggtaaaagtaatttacagattcaatgctatccccatcaagccaccattgactttcttcacataaacagaaaaaactgctttaaattttgtatggaaccaaaaaagagcctgtatagccaagacaatcataagcaaaaagaacaaggctggaggcatcaggctacctgacttcaaactatacgacaaggctacagtaaccaaaaaagcatggtattggtaccagaacagatacatagaccaatggaatagaacagaggcctcagaaataatgcctcacatctacacccatctgatctttgactaacctgagaaagacaagcaatggggaaaaaattccttgtttaataaatggtgttgggaaaactggctagccataggcagaaaactgaaactggaacccttccttacaccttatacaaaaattaactcaagctggattaaacacttaaacctaagacctaaaaccataaaaaccacagaagaaaacctaggcaataccatctaggacataggcatgggcaaagacttcatgactaagacaccaaaagcaaaggcaacaaaagccaagactgacaaatgggatctaattaacctaaagagcttcctcacagcaaaagaaactatcatcagagtgaacaggcaacacagtataagagaaaatttttgcaatctatccatctgaaaaagggctaatacccagaatctacaaagaacttaaagaaatttacaagaaaaaagcaaccccatcaaaaagtgggcaaatgatatgaacagacacttctcaaaagaagacatttatgcagccaagaaacatgaaaaaacacttatcatcactggtcattagagaaacgcaaatcaaaaccacaatgagataccatctctcatcagttagaatggtgatcattaaaaagttaggaaataggccgtgcatggtggctcatgcctgtaatcttagcaccttgggaggccgaggtgggccgatcacgaggtcaggagttggatatcacctggggcctacatggtcaaaccctgtctctactaaaaatacaaaaattagccaggcgtggtggtgcacgtctgtaatcccagctacacaagaggctgaggcaggagaatcacttcaacccgggaggtggaagttgcagtgagctgagatcgcaccattgcactccagcctgggcaatagaatgagactccatctcaaaatcaatcaatcaatcaatcaggaaacaacagatgctggagaggatgtggagaaataggaacgcttttacactgttggtgggagtgtaaattagttcaactattgcggaagacagtgtggcaattcctcaaggatctagaaccagaaacaccatttaacccagcaatcccattactggctatatacccaaagcattataaatcattctactgtaaagacacatgcacatgtatgtttattgcagcactgtttgcaatagcaaaaacttggaaccaacccaaatgcccatcagtgatagactgggctttctgatcttttgattttgaggtttcattgaatattagcacagattttcttatttttttttctgtctcaatatacatttaggaaattacttcctaataagtaagaagtacatctagatagttgttggatgaaatatattaacattagctattgcttaagaaaacaactggataatgttttcctacctttttaatcatctcatcctgctagtgtactgtgtttgctcatgtttatgaacctaccacacataatataattggctctgaacttcctgaattgcaaatcctgtattcaataatttcatgcatgcagcctatttctcaatttatttctgggaactctaatcttttgcttcacagatactttgaactggcatctcatgtcttagtctgagttcctaacctttttatatttttttattatttgtattatttatatattgatttcttatttctctcccattgaaatgtaagatttatgagggcagaaaacttttccatcttgtccaccagtgtttctcaggcacttagagaactgtgtggcctaagagggattgattgtgtactcttacattattctttttcatttattatttcatttgtttcttataaccttataaggcataagtgctattctgtaggtgaggagacgaagacatacagaggttaaataatgtacccaaagctatattgctctagtagttggttatttagtgatttttttttttggctctgtaaatttgaggccatttttcttcagaacattcccttttccccagcatctttatggtacctggctatgcacttgcttttgctcataagcctaggttttgtctggtcagtcagtgaacataaataaggaatctgctaaccaatcaacaaggaggaagggagaaatcagtgaaaatcgtcactaatgttgaagataataaacattttggacaatgactgatgttttatgaagagcttttcataggaattcttatttagttattctcatgttacatgatggggaaactaatctcagagttgcaaatgttaagtgccaaaggcaacacagccaaaagtctatagctggtgcattagtccgttttcacgctgctgataaagacatacccgagactgggtaatttataaagaaaaagcggtttaatggactcacagttccacgtgtctggagaggcctcataatcatggcagaaggcaaaaggcacatcttacatggctgcaggcaagagagaatgagcgccaagcaaaaagggaatcccttataaaaccatcagatctcatgagatgtattcacaaccacgagaacagtatggggcaaaccacccgtatgattcagttttctcccaccaagtccctcccacaacatgtgggaattatgggagctacaattcaagatgagatttgggcgggggacgcagccaaatgatatcagctcgtgagtgagcatcagacctggggttcacatcctcgtatctttgcattctttcccatccattgtattgtgggaagagcagatagttctccccattcccactcttctttgttgtgtgtgtgtccactgttgatgagaatgtcactctttgttattttcaagtttttttagtcactgagctttcccatgattttcataggtcattggaattttgtattgttttatgaaatatacactgaaataagatccttggctacaattacagttttgtataatttagagagcacgtaggcaccattttcttgcccaagaatggggatagcaattcttttactttctaccacataatgtagctgtaggatgaaatcctgtagctgaagtttctcaactccagcccattgatattttgggccaggtgattgtttgttgcaggagggtgtcctgcgcattataggaagttcagcagctaccatggcctctaccctgtagcaccacccgagttgtgataatcaaaaatgttttcaggcattatcattttttttttggcttccaggggatgtaaaattgcccatggttgagaacctccggattaaattaagataataaatgtgaaaatgtacattttaagacaattttccaattcaaggtgttattaggatgagatttaagaacaatagaaaaaatcattgtggcagatgaggtaagcagcagaagggaaaacagggtatagacattaaggactagagttggctgtctcctattatagtcttgtgaaagctcactcatacagattcctgctataaatttcttgcttttgtatttttccaagcaaatatttaatacaatgttgcctgctaatagaacttcccattacagatttaagttttcttttcttttcttttctttttattttatttatttattttttttttgagacaagagtctcgctctctgtcatccaggctggagtgcagtggtgtgatctcggctcactgtaacctctgcctcccagttcccagtgattctcctgcatcagcctcctgagtagctgggattacaggtgcccaccgccacgcttggctaaatttttgcattttttaagtagagacgaggtttcaccatgttggccaggctggtctcaaagtccttgcctcaagtgatctgcctgcctcggcctcccaaagtgctgtgattacaggtgtgagacactgcagccggcctaagttttcatttctttatgaaatactgtgtagcatattcactaccatatgatgaataattaaaactaaattgcaattgtcaaaataaatgaacacatcacatttggaggtagaaaaattcctaatttttttttcccacgtagtttattgcatactattcttatttgtggtatttggtgttatgtagttactcaaagttgttacagcatttatactatatttgttttgttgaattgaaatcatagaacctgccaattaaatttaaaacaatgtcatacacgttggtttctctattacttacagagtaaaattctcaaagccccatgaggcatccttgtcttaatggcatggatatgttactgcatgtgctcttattgtccagccagctggtattcatatataagattttattaaataacatcttacacattatttatgtgataggctttggtgatggggctttgagaaagctgtccagaagagagatgtgagcattctctatgttaataactttctactattttattttaatgtaacttgctacatttgccatctgggatagaagcttctgcatcaaccattaactatcaacaccaactattccaggctgcagaatttcagtttgaaacggttctaaaattctatggaatagtgaaggcccgcttgcttcattgtgctttcctttaagtggagtattgcccagatgtggaagttagatgtggaattttcagacagaactgtttaccttgagaatggctgggcaccttccatttgtactactttttattattgtcagaactgatcaaataaatctgcccgagtatctgtgtgtgggatgcatgttgaaagcgattttattgttgcccaataagtccccaaatgctgtcgtcttttgctttccctctcccatcttaagtgcctttttgcaacttgcctcacaaatcacattgtctctacttattacccaggcttttctccagctggtaaaatggatttttttttcctcagccagattcagagtttgccctgttcttattccctgtatgtttcccttcacttttaatgtgaaaattgcaaatatatttctaaacccttctgcacaacactttccatttatggaaaactcacactatataaagtaacgagaggagatatctaaaatgtgtcttccattttctgctctgtatctccaactggaccaatttttccagataatttctcctttctttccaactttatctgcatcgtagaattcagagaactgaaagcatttcttcctttctttattttttttcatattctttctctactgcagacttcgctaactgatgaaacactgccagagcccacttggactgtttcgcaactttacttaagggaataaaagctctcatgctgaggtaaggcaaacagtccatgtaggttctcactaaaaagaagagtggattttataagctcgggcctgtcttataatctctctgtgtcttgttcttgtatgtaccttgataatttactatctgtcctttttctgcccagtggatttttgaggttcacaaatgtgagatacacaaagatgtgatatacacttgctgttccgtgtttttttttttttgcaaatatgcattttccctccagaactgttactggtaactatcctgagactcaagatgactttaaataacacttttttaaatactatacttagttagggttagacttggctgcaagaaacagaaaattcataagatcaggagcttaaatgagatacaactatatttttctctttgaattaaaacttgagataggcattccaaagctactgtagtgttccatgatgtcagggatccaggatttgtcagacatagcttttgtcctcatgattgcagatggagcataaggacaatgtgttatagtcacattccaagcagaatgtgaaaaggtacaattatttccttgtaaggaaagttcccagtagttgtggtacaactgtgctggttaattctatggatcggtgcttagtcagagggccatgtgtggctgcaaaaaaggctggaagatacgatacagtcctttttcttgtggccatgtgtccagctaaaatttatgtcctctaagaagagaaaaattagcagtattttgctctcaaacattaattttaatatatcctatattttaaaacactgttgctgggtagattgtgaactacatgtgggcaaggactgtgtataataaaaaatattatgttgtcagctcttaacggtgtcagcaaaataatgaataaatattcattgaaaatgtacatggagagatggtatttttatcatgtgaaatatgactcaaaatgagactgattttttacattttaaaacaaatgcacccaaccattgtttattcattcagtaatcactgagcgtatataccgattcattaaagtatcatttttctttctttaattaaaaatcttaaattgatatataatagttttacatattcttggagtgcatatgatattttgatatctgtatttaatgtagtaatgatcaaattagagtaactgggatacctattacctcaaacatttattttttctttgtgttgggaatactgcaaatcttctcttctagcgattttcaaatagacaataaattattgttaattataatttccctattgtagagtcaaatattagaacttatttcttctatctgactatatttttgtgccctttaaccaacttctcttcatctgcctctcccttcctttccaagcctctggtaaccatcatcctactctctatctccctgaaatctacttttttagtttttgtatataagtgaaaatatgtgttgtctttttgtgcctggcttattttacttaacataatgacctccagttgagcaaatgacagaatttcattctgttttatggccaaataatattccattgtgtgtagctataccacattttatctatccattcatttcttgatggacacaaagagtaattccatatcttggctattatgaatagtgctgcagtaagcacggcagtgcagatatctcttccatatactgattttctttcttttggatatacacctagcagtgacattgctggatcatatggtaattctatttgtagttttttgaggaaactccttacttttttccatactggctgtgctacttttacattttcacaaacagtgtataagctttcccctttctctgcattcttgccagcatgtgttattttttgtctttttgataatagctgttctaagtggggtgaggttatttctcactgtgttttttacttgtacttttcttgatggttagtgatattgaaaattttgtaatatacccattggccatttgtttgtcttcttttaaaaaatgtctatttgggtcctttgcctattttttaatgacattattggtttttgctattgagttgtttgggtttctcatgtattctggtgattaatctcttttcatatggaaagtttgcaaatattttctcccattttgtaagttatctcttcactttgttaattgtttgcagtgcagaagcttaaaaagcttaatgtagcttcatgcaatccaatttgtctattgttattttttttgtttttgttgcctgtgcttttgaggccttaccccaaaaatcttttttgagaccaatgttctgtatcatttcctctggtagtttcatagtttcaggtcttacatttaagtgtttaatccattttgagttaattttttatatggtgaaagatgagaatctagtttcattctcctgtatatagttttcccaacactattttttaaatttatttttcatttcaataggttttgggggaacaggtggtattttgttacatgaataagttctttagtgttgatttctgagattttggtgcccccatcacccaggcagtgtacaatatgtccaatgtgtaatctttcatccctcacgccactcgtactctttcccctgagtccccaaagtccattgtatcattcttatgcctttgcgcccccatagcttagctctcacttatgagtgagaacataccatgtttggttttccatttctgagttacttcacatagaataatagtctccatttccatccagattgctgtgaatgcaattatttcgttcctttttatggttaagtagtatcccatggtgtatgtaacatattttctttatccacttattgattgataagcatttgggctggttccatatttttgcaattggacattgtatcagcaccatttttaaatgagactacatgcttttggagctttttctaaaaatgagttggctgtaagtacatggatttatttctcagttctctgttttgttccattggtccatttatctgtttttatgccagtatcatgtggtttgtgttactatgactttgtaatataatttgaaatcacatagtatgatgcctctgcctccagctttattctttttgctcagaattgctttaattattcaaggtcttttgcgattctatagaaattttaggattgtatttttcatttttgtaaaggatgtcattggtattttgatgaggattgcaatcagtctatagattgctttggatagtataaatattttagcaatattaattcttctaattcatgaacatgggatatttcttcatttttaatgttcttttccatttccttcatcagtgttttatatatatatatttttttttgtggagatcttccatgtctttggttaaatggattcctagaattttttttgtagctattgtaaataggattgctttcttgatttctttttcaggttgatctctgctagtgtactgaaacactactgatttttgtatgttgattttgtattctgcaactttattgaatttgtgtatcagatttaagagtttttcgtggagtctttagatttcctaaaataaaaaatcgtatcatctgaaaacaagaataatttcacttgcttttcaatttgtatgccttttctttctttttctttcctaacagctctgactaggattgccagtactatggtgaatggaagtggtgaatatgggcatctttgtcttgttctagatcttactgggaaggctttcaattttaccccattcagtatgatgttagctgtgagtttgtcatatatgaccttaatcacgttgaggaatgttccttctatacccattttgttgacagttttcatcatgagggctgttgaattttatttcatgcacaagtgttgtttttcttatagtgacttctttaaccatttatcaagtcatgttttggatttctccttaaaaatgagtctcagacttaaggttcaaaacacctatggaaataattctctttacgactaatttttctctttaagcctacttttcttcatttctcagagaagttatcttgctctgataactttttaactcttcctaaaaatcaaatctccccccaacaagatggagatttggtcctgctgggggatttttaagtaagggctgttagctgtgattgaggtgcctgtatatatgagacaaggagccttaagggactaggatcaaattaattaaaagtcacatttattgagccctgccattgaagaatttataatgtcttctatgcaaaccaattcattggtaaggaacagcattgctattctcagcattttggaaataccacaatgttggagtcgtctcagaaggatctctgaagagttctgggaaggtgacagtcaacagcagaatagcagctgccaccacagtcaagcagttggtttgcttggcttggaagttttagacatcaaaggagtatggcttcttcaatactaaaaccagtgacaaaattgcaaaagttatttttattcctcttcaaatatgagcaaacattactgtgattcagcttatttttatataatgttacagggaatcaaattaagaattaaatgcattttttggcatagttatgtcttgtaaagaaagaaagatggtgccaggggaattttcctttcaaatatgtaaagaacttctaatgagtgaacctttcctgtgtcggaaagatagcattcacctcctttcctggcttctgtgccaacttacgattgtggtgtgtagaaatttagtgtcagccactgaaagaactatttcctaagatgatactgctttttactcaaggaataagtaggttccctttgaattgacctgtgtgtgtttggaaaacaagcttaaatatctcctcttctcataggaagaacactatttcaaagagccattttctttcctaacaaagaaattcatactgcagaaaaatcagcaatttcacagctggtttttgaaatcctgaaatgatgtatacaaatcaaagcaggagagattcatttggaatgaaaggaatatttgaattgcatcccagtttcgaataggatattgtttcacggttctacagtattataaacatgtcatgtctgttatacatgacaatcatatctcatctgtgactcatgaactttataagaaagtgacaatttgaaagcatagaattgcaggattggatggaacgatatcttctaagttatttccactccttttcccatttttggttgaccatgctaattcccctctaaaacattcttctgtagctacttgaaaacacccattgcttcttaaagtaacctattgtcaaagaatattggattttcttatgtacattgaaaaaatgacactttattggttttgattctaccaccaagagtcacagggaactttctatcttttcatcatatatataacaggcttttcatcttatatgtaacagtccttaaatattttcatattgtaataatttcctatggaacctgttgacttttacgctagagttatagtgatggaggtaatgagaagtgatcatattctggatatatggcagcagtagacagaaggtgtggttcataggaattgatcatggaatggatgtgggctgtgagaaagagcagtcaatgtttttgacctgaagatgttttactaacatatgttaagcatttactatctgctcaatatactttgctaggcattgtagcacaattaaatgtgcatttgcatagctgttcgatgatacaggtaggactattctctaagactaagagaacattagtcaggcctcttatggtgagggaggggttccctttctttccattctcatgctttgacttgagagagcaagcctatatgttattatggatcagaattgagatttcatgctcagttttaagtctaaaaatatgcttttcaatatctagtatttacatgcgtgtgacttctcaggaattataacgagagcctgaaaaattaccaggggcaacattttcagtccggagatgttataccccagttactgccactaaattttaagctccttgggagcaggaatttgattcttttattatattaatagtatctgttacataatattaactcagtaaatgcagggtatgctattgtaaaactatagtctcagtctctgtaagtggattttttaggatagactaggtcctagttaatgtgatatatctctatttctgtctatctatctgtctacctacctacctatgtatcatctatttatctgtcaatcaagagaagaaaataaagaagcactcttggagaatcaaaattttttataacatggtatgcaactcccttacgttctttatcagccacctgcatgcaaacagcattatgtctgaagttaaaacatgtaagatatatgagagtggaatccttggtgcatttcactcttgaactcttgtctatggagtaagtagcctgggggtagtttctcctcctttttatatatgtggggagaaggaattaggtggctgattatcttgtgctaaataggtttctctgccgatccacaaggtggcagggagtccttagtgccactatgacagattaaccaaataggcatctgtcgaaatgtctgatgcattagttgcactgcctgtaaaagagatgggcctccttgagaaataaatccacactgaatttcaaatgtggttgtgtccccaaaattagcaacgttttcaaaggtgtacccttcaaaggagagcagaaataaactgtaccttaaaagaactagtgctcagaggcctttgtttaatcaatggttagtttggtggtgattgcacaaattcactacattaaatttaatcagggatgtttctggtatgtgggtggcatgcttactgattaattcatttatattcttgaaataacatatgttctcctggatgaatttccacagtttggtaattccacagcatgcatttcagcatctctaaatggctgttttgttcactgtcccagagcctaagacatgctgggtgctgggtactgattagtttaccagactaagaatgacagacaggaaatggcaccattttaatctctcagaagaacatcagaggaatcatttcggtggctgtaaatacttcaggattttgatgtcaccttttcaagttgctttaagaaatcacttaggaatggtttgggagaccatgatacaatgaggtcccgcaaagaattacacctttctttgtcagggttctgaaattgattaagtataactatgtccgtgatgtaatcgattacattaaaactatcattttggagaaaagagacctgatggattacagagtctctacccttatttataaaaaacgatgaaatgaaactcagtagttcattgacttttgtagatggaaagatagtttgtagtagagctttgcattcaggactagtagttgccaccaccccccgcccatcccctattatagccagtttgtttgtttgtttgtttatttatttatttatttatttatttatttatttatttattttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctatttatttatttactttaacttttattttaggttcaacgacatatatacaggtttgttatataggtaaattagtgtcatgggggtttggtgtacagattattttgtcacccaggtactaagcctagtacctgatagccagtttaaagtgtgtacattggggaagggggggaatgaggttgttcttagacagttagaggcacagagggtatatatatatatgggattgccttatgttaatacatcacttggctttaagtgtgggaatggacaggagtacttgttatgacctgtggggccctactttccttcattctcagagagattttgcaaattgcctaaaatatctgttaatatgctctgtggctacatgcttacagacatgatgacaaggaggggggaaaatattgttcattgttgtcattttctagctggaaccatgagatttgcttaaggaagactgaaggctagtgtgacagaaaatggagctcaggaggacccagaataaattacattcctttggagggtcctgagaggggcaggccatggcttagttccttctattccactcatttcttacagttcagctgcctcccgatgtgcagttgtttagtatgcaaatcaataatcattacctatgtgaagtgttagttcacaggcgtgcaggctgtggtcagttggtacctgttccctcctaaagaactatctctgaagttgaacatctctgtttttctttgtataaatctgaatattaattagaccactgcttattaacttagggacctctctgcttttggtgacagtagcaggcagaatatagatggtagaaaacgaaatatcatgctgtttctgtaaacggtttggtgtctccatataataaaactctttagaattaactgcctccagaaacagggacaaatgtgatgtcctttctctgccccttgaattaaataacaaaatgaacagcagatcattttgatgttgctactccataaagatcattttgttattgttactaggagagagtggagtgtaatggaaagaatacatgtttacagctgggctgtaatcttggatcttctgaaaagtaagaatatgttcttgaaggaacctcaaattttgtgaatgtgcttattattttaaagataattacatggattcaatttctgtctccgtagtaacctgctgtattatctttctctagctatataatctctctttgcctccatttcttcatttgttaaatagggataataatagcacctatatcataggtttattataaaaaatgaaatggattcacatttttaatgttctatgtaattacttatcattgttgttttaatagggaaagtattggttatataaatagccaagaaaacagccaactgagacttttcttcctagattaccttggttatatcagtgcttctgggtgtggtcactgatattctacagcagaaacagctagtggggtccccaactaaagaatgtatcttattggaggctaagaattatgaggcaactatctctgacttgagaaccctaaccttatattgacatctgagatttattcatcaataaacacctttttgtaatccagaatcatgttatgtcattactttctatatcagaatttaaatgttaagggaccaagacattatgcaatgaatactaaaatgttactaaaatcatgtgttgtgaagaatatttggaaatatggaaacatgttcacaagatgttaagtaaaaaaacaggttagcaggttgtaaaacagtatttcagtatgattctaaattgcaatcattaaataattttataatcatgaaaaatgttattaaaatattataatcctgtgataaattctaatgagtactttcttgatttggctttaacattttccaaaattaaaattacaagttttttttctgattataacagtaatacagcttactactgtagctattacaagcaaaatagaaaattaggtaaagatgattaaaatcatccacaatcccagtttcttaaaatggccttactaagatttttaacaaaaatttactccacatatttatttatgaatttttatatgcaccatttctctaattttcctaaatggagtttataatatctacctgttttcactcaataatatattgaactatatgttgaccctcatcattgtcccaaagtttaaagtcattgaatagagatacagcaatcacttactgatggagatgtgtagtttggttgtcttacaatttgtacattaaagttatactatgataaagatctttgtgcataccaatttaccctaccaaaagatatgagaatatttccagttgaattttaaaatgaaaacctcattattcttttaacttactctcatttgattattgaggtggagtatttttccataggcgtctttgagcccctcaacttgacaattgtattgacaattattcactgtatgattatcgtgattattgcaattaagtgattacttatggtttctcatttattggaaggagcattgtaagggtagcagaaacactacagagcctttttttttttatttaaccactctcttgccctggacatgaggtggtgattggactctcagatgctgcttttgtaatatcgcatggtcaaatcaagccctatcaaagtgccctgtcatgtcctttcatatctccttagggttaagtatgtccccaaagccctgcgtcttgaggtaggcatgggaattatcttcaaaaatatcaacataggatataactttctctcttagattagctaagcttagaagaaaaatttctttgtggtcaaatgtttctgccatattaaaatctacaagtcaggtggtgaccagattttgtgatgccatccaaaaggttttagtacaaatttttcttaaaaatgcagtaagtaattgtaaactgtgatacttttaaattatctgcaagattattccatgaccatttttaaaatagatggtttttctgttgtggtcttagttgtcattttatagttgaccccacgtgtaacttttcgaagactctcaggattcccttcagtcctattctgtgtatctatctagtcattgtcccagtgaaatgataaaaggcccaactcagcttgttttgcaatgtgggcaacaaacatctcaataggatgtgtctcttccagttgtttttcttgtactattgatgtcttatggggagatatttaacttcacttcttggtcttattcgtagcaacttccatgactgatgagccagttgaattagtctttgggatagtcactaagtagatgggaacaggattttcttggttggaagtccatttcttgaatattcaagtttgtttgtcctagaaatttaattgactgagcctgcctagtaaaggaaatctttgtcatgccagtgtgaagttctgcttcccactttactattttcctcttaatgcagtactaatatatgttgaaccaaaaacaaaaacctgggcttatagcataacacacctggtattaaattgtggtaccaccatttgttatcctggttagttaacaactttctgaaaataaaataaggataataatatctatcttaatgtatctttttttcttatgaggtatctaagatagaagaatttctttttctttgccttcgcttaatagaggttagcattattttattttatataaacatagaaataaacatctgctggaaactcatttgagagaaaacaacccatgttggatcttagggaggtagatacacttttccattctttcttcaatctacagaggttcatgtcatacccacatcttcatctaaaaatcaaggaatgaggctggataccgtggctcacgcttgtaatcccagcactttgcgaggccgaggcagacaaatcacttgagctcaggagctcaaaaccagcctgtccaacatggtgaaaacctgtctctactaaaaataaaaaaattagccaggtgtggtggtgggtgcgtgtaatctcagctactcgggagactgaggcaggagaatcacttgaacccaggaggcggaggttgcagggagccaagattgcaccactgcactccagcctggacgacagagagagactccatcaaaaacaaacaaacaaacaaacaaacaaacaacccaggaatcattctagacattatttgtttctcaaatctgtaattgttttaggatctatgtttgttttcttttcaccaaaactaaagaaacactgttccttatttgctttttttttcctcagtctggctacttacttttctccctcatagacaaatgctaacaaccaatgaatcaccatatttctcctttattaaagctgtctccaatggcattctcagcaagttaaaatgtcaagtatatgggcctttaagaaaggtttcaaaagatatccctggggagggagggaagagaaatttgaggagggaggagggaagccatgtgacctgagaagcaggaattctgtacataaatactgaagtttactgtcaagcttccgagtaaaaatgttaaatatttgcagtgtccacaacccatgtccctgtgataaggctggttaattcctagaacataatgctaggaattcaagaatggggatcatatcctgagtactgatgatccatcttgatactgtgtcaaagggcacaggatgaggaatggaagggtttggagagtgagaataaattactgcaaatccaaacatctgactggataaactactccaagtggatatcatttattattcactccatagaaagattagaatgtacaccctagggagattaaggtaagagtaagagagatgtctaaacattttatgtgtccatcatctacgttgcctgtttatcagagtctgtcactataatgtttactgctgtaagtggttaattatgaatatatcagctgaatgctttcatgtcagttgagctgtgcagttgccacagtgagcactcttttcatgtggacttttggataaaccagcgtttagagattgtgttttataaattatatgaccaaattccaataccacatggagaatacgtgatttatgtgctaattggatcatgtccattagacatcctcataactatcttttatcggcactacagtttttatttactaaaacatagtcacatgaaagtttcctataatagtattctacactttctattctctgactcttaggaatcactactccttctgaactcctttagcaatgaatttcacaattatatattattaatgtgaaattcacaattatatattatatacatttaagtatatgcagtgagtttcacaattacatgttctttcatgtgtttatttttctcatcaaaaaattaaatcttggccaggcgcggtgggtaacacctgtaatcccagcactttggcaggctgaggcgggcggatcatgaggtcaggcatttgagaccagcctggccaacatgatgaaaccccgtttctactgaaaatacaaaaattagccgggcgtggtggtgtgtgcctgtaatcccagctactcaggaagctgagtcaggagaatcacgtgaacctgggaggtataggttgcagtgagccgagattgtgccactgcactccagtctaggtgacagagccagactctgtctcaaaaaaaaaaaaaaaaaacaaaaaaaaatattaaatcttgatttgaaagatttgaaatatcaggtgagtataaaatcattggtaattctaacaactgaaattaataatttcaaaaatattgctttttgtatgtctataaacttttatatattgaaaaaacgtatatatgcaaatatgttgaattcatgtcatatctttttaacattatctgcattataattttgaatatctttttgcttaattaattaatttatttttattatttttttttgagacagagtctcactctgctgcccaggctggagtacagtggcaccatcttggctcactgcaacctctgcctctcaggttcaagtgattctcctgcctcagcctcccgagtaggtaggattacaggtgcaagccactgtgctcagctatttttttgtatttttagcagagagagggtttcaccacgttggccaggctggtcttgaactcctggcctcaagtgatccacctgcctctgcctcccaaagtgctgggattacaggcgtgagccactgcggcaggcttctttgcttgatttatgatcttttaaaaaatttgtcatgctgggtcaattaagtggtaggtatttagaaagtaagactcttctattttttaggatctctgtggcatagtgcattgcaagtagttctcaataaatagcttttgttgtaaactaacacactggttactttctaaagtcatttgctcttttaaaatccctttggtatactaatctatactatatcactatacttgtagaccaagggatttgtctggccaacatggtgaaaccccgtctctactaaaaatacaaaaattagatgggcgtggtggcgcgtgcttgtgatcccagctactcaggaggctgaggcaagataatcgcttgaacctgggaggcaaaggttgcagtgagccgagatcgctccactgcactccagcctgggcgagctactgcactccagccaagggtttggtctacaaatatagtgatatagtatagattaattcagttgctttaaaaaaatccatatgccacaggatggctcaggatatcaatctatatcttagaaaaattattatacaaataaataggcaacaagattgagaaaaactggtatatttggtaaaaatacaccaaaaaagcaagagaggaggagggagatatgtgttttagaacccacacattttcaccaggtgaattttaaaggctataagagttcataaaatcttagcatcctgagtcatttgagagtctgataaacatcatttaaatacgtaatttaattgtttctcttttcttgttagagaaaggtggtgcaaacttattcctggaagacggtcagccatattaataatgagcaaaatgcctattgagttggttttttaaatactaagaaaatgacttttgaagttaaaacacatgctaactgttgcttagttttaaatatatatatatggagtggaacaaaagttcccactcaacagcttactgaaaaatacaaaaaggaatgcagttttcagcaggttctatttgccataaaacattttcttttcttaccattgttttatttttttctttctggtctccccctcttgccaacgttcacagctggacatctttgtccatctttcaggtactttgtgttgcatatccgtacgtgaaacacatatatgcataactattcaggtttccctcctgtctccattgttggcagaattctcattcaagttaacattaatatacttttttgctcttctcttcctcctggtttgtccttttgtcacttggaaaatattgatttccctccattgtaggtgagatgcacctacatggctcatttgtgcttacttccttcttgtttggagactcagcaagttcagcacaatgctatttattgaatttatctgtcaatttcttcttccttgcatggctgactaattcagtggaatcagcacaataccagaagcacagaggataatggcttaaattttttttttcgcagaaaattgtaaatcaaaagtagagactaaatttgaggaccaatcccttcagaaggttgcaacttgtaaagtgtgtgcaggactgtctaggtgaacatggcaacagatatgattttctaatggggcacttctcagcttttcattaaatgtctaagaaatacacagaaagacatgaattggcagcaggattgtgaaataaaaatgagaggagcctctaacataggcaaaaactttcctccaaacagacaaacaaaagcgtataatcaatgaagaaataaaaatcagaataacctcattttcttcacagtacaaaatactaaaaaatcaacagagttattttcatgaatggcttagtctttggaattggctttggacatgcattcctacttcacacatcccagtgaacctcagcacattagctggttactgagaaggtaggaaagtaaactgacctttaccttttgtgaactgggtgctacttactaggatcttactggtctctttctgccaaggtcagctcctcttgtgttacaacagagaaacgactaatctcagaatgtaacatgttttagataagtggtatggagaagcagtcatgcttagttgttgaaagagaagtatacagtatgcacaagtgtatacttttgtaagtttttatgctgttcaaagaagaactttaagatactattacagcatagtcattaagagaaaagatgttaaatagacaagatgcttttgaattgcaagacccctgtgcctaatcctgaaaaagttttctaacttctttgtgccttagtttcctcatttgtaaaatggccattaaacacttcataatattactgtgaggattaaaaaagtaagaactaagtccagtgtttggtaactgtagtaagccctagatggatgattgtcactactgttatttaccctaaataaattcaatatttatctttagttattattataccacactgttactaagttaggcttagaaggaaatgactccctgttagctttgaaggttgagctacaagatcatgcccatcaagttaaaattaaggttttgacctgacaattgaaggtgcaagcctagagagattaccttccacataagcttaatacctggcctaagtggcttgctcacgttatctaagtagaaacaaactgaaacaaacaaaactaataatcaaaactaataaaaacatccaaataaataaaattattgattcaggcaaggaataaggattaataaatttgataatgaggggctggataattgtataatgtcaaggtggaatcacacgtgtaactttctaatcaaagaaaaaaaacacacactggagagatcctactatttccatcctattccagtagtcagtcagttgttatatgccctgggatataatgcaagatataatgagcaactttcacaatgtagtctagtcaaaaaagttttaccaacatcagatcattaggagatacaggagatagaagaacaagggagacatcatcacatggatgcaatcagacaaatgacacgtgcgagacattctgtgaaacagcagacctggtctcttcaacaagtcactgtctggaaaaaggactgaactatattaagaatgactgaagaaacagaatcagatgcaatgattggtcttgaattagatacttattttgtcaaaccagatgaaaaggcatttttgacaggattgcctgtttttgtaacccaaaatatgcattgaaaaaaataagcaagacttttgttaaaatatctttagacagaattttggtatatatatatgatatatatgtgattatatctacatatatctatatatatattctgtctaaaaattctcacaattctgtgtaaagatattttagacagaattaggagatatctgtatctagctctagatatagctaaatatatattcctttatatatctataaatctatatatctagctatatatatttagatatatcttgctctagatatatatctagctcttatatatagagagagagatagatatagagctaggtatagatatataaaggaatatatatctatatagtatgtttatgacctacaagtattcttttttgatcaggttttcttgaacatcagatatatgtatataccagaccattcaacatgcatttatttttttatttttatctttaaatagagacagggttttctcatgttgcccaggctggtctcaaactcgtgggctcaagtgattcacctgcctcagcctcccaaagtgctgggattacaggcgtgagccactgcacccagtatcaacaggcatttataagcataggtataatctagtgctcttgattgattaaaagtatattttgagaattgtttattgtgattgcttgaaaggtgattattataaaaatgagtaaaataatgaatcactactcccttttttgtttcttattttgtttgtttcttccttttgtactcaagtaacaaaaatcttaatttagctctgaggatacaaatgaagagtaatgtttcttgcccctggtcccacagttagtgacagacagtcactaaaaattgaaatgcagacagtccaatttcagaaaccatgctcttgaccaatacattgaagggtctttagctattagctgcctataaaatatgtggtcataaccgtagagaacacagcaaaataccacaataaaaaaggataaatgaaacttcactatttttcatggaaaaacccaacttgtattgcctgcttcctttgtcagctttgagaacttcagtatgaagttttgtacctatagctccagctcctgaaaaaattgttccaaaagcctcaacaccagttaaattaagttcctgacagaagttggaaacattatgagaatgacacacatggtttttgttcagatcatctggggaatgcacgtcacactggcatcaacctccaacagagccttgggatgacagaagcagccgttcggaggaggcctctccttgctctgttagtgaaaagttgagatttggatggtatttttcacactcttgacagtttatgacacgctgatgggatgaaacagagagactgcatactaaaagttggctgtgacctaacaagcaaagttacacaagtcatccctggtcacataagaggtttcacctcctcatttctaaaagctaattattactagctttttgtgattaccagatatacctcttccattttttatacctcctactctcttaacatggacagcattgttgaactcaggatctgaagtcagacagcattgtcttctttgagcctcaatctgcttgtcaatgaagtagggatgatgacaattctttccatatagtgtagttgtgagcatgataaaatgcctagtacagggactgtctagtaactcctaaccacaactattatgcttgttagtccccatggcctatttattttaagcccaaagcatcttctggagctaagcactgtaatgcccttgaagtgttttttaatctcttcagttctgtctactgcacgttgtggtcttacactgctcctggccactgttgagttattcctaaaggaatacagcaatttcagaggccttctgaagctccctgtcatgcctggcaatgtcattatataccaactgatacgtttttacttttcccaattcttgacaaccttctatagtagtatttcacatatctgcttggaaaaaatatttgggtaacagcttttggtattgctaggtgttttcggttttcttcttacctttttgtttatcgtagtataattataggaattaattaatttgtcgaattgtgttatttctctgctcgtctagcatcatcttgctgtatggagataaagagcagttaattttgagtaatatactagaagtttggtattcgtgactctcatttttggtgaaccactctactgactcaaaaacaaagatttttatgtgctttgaaattttaataatcaggtaatgtctaacatttcacattttctccaatagccactcttttttgcttttatttttgcatataatcctgctccatttctaaaattgccctttgaaattttcttattttcctacacattccagtttattactatgtggaagctgataatatttatactttgttttctaggaggtcattgatataaaattttattttatggttgattttcttgtgaatgggtgttttacacaattttcaagtaattggcgtggattttatgaggccagtcaaatgtagcaaacattataaaattactgaaaatgtatcagtgatgacaaatatttaatgattggtttattttgattggtcgtagttccatttttctctaaggcatcttccttaaaataagcatatataaatgacctttaatgtatacagcatgcattttttcattctctagcaatgagagcaagcacataatgttgtgatcactgttagcccatctgtgttttaacatgctctccttagttttattctcctgtgttgttcatttagtatatggcctcattcttccacttttttttctgttttgatgaatagtttggataataatgactgacccaaggtgtgcaaatgatttaagcaaacaaagcaaaactattccactgtcttttgaaatgtaggcttcagggtatcttgaattgcattcaaaaagataaaactcttcatcagaattaaaaacatacgtttacacaaaatcatgtacacaagttcatagcagcattatttgtaatagccccaaagtagaaacaactcaaatgttcatcaactgataattcgattaaacaaaatctggcataaccataaatggaatattattcaggcataaaaaggaatgaagttctaatacgtgttacaagttggatgaactttgaaaatatgctaagtgaaagaagtcatatacaaaagacttgcaaggttctatgccttcatgtatatgaaatacccagaataggcaaatccatagaaacggaaagtagattagaggttcctaggagccaggtacagaggggaatggagagttattgcttaatgggtatggagtttctttagaggaaaaaattctggagtggtggtggctacacaattttgtgaaatatactaaaaaccattgaagtgtatgctttaaaaaggttaaatggtaaatgttacattacgtgaattttatctctaaaagcattttaagagaagacattataataaacagagagtacaaagatcagaagacaaaagaaattggtggaaattatttgacattatgaagagcattgtaagtctcaatttcagggagaattgaccataattgacaaaatattgcataaataatatcagggatgcatttggataagaaacacatattacaatcctttataatgttaacttagtatgtattccagtttccacaaatgcactccatctcccccaaagtataggcaagtagtccttgaaagttggaatggaaagattaagcaacattttcataaatatgtcactgaaacaggctcacaaagcagtacatgccatataatgggaactggggtatagaagagaggttaatcaatgctgtatagctaaactggaagtaaagagggatttcataagagaggttccctttaaacttgttttggaaggatacataggagttctccatagtgtggataatgagggaacaatatgagcagtaagaactttcatctaacctttaacttctttcttctatccagaaagggttagtcaattttgcattgagcaccatcacccattccctaaatacaattcaaacggcttacaatccttgtttttttggtttggtatgtaaggtttagttttcctccaacttctgcatttctcttcaagggaggccattaaaccctgtttttatttctaatctacaaaagctaaaaaagcatatttccctttatgaatttttcatatgctcatctgatgcttgtgtgctctctgcccctttgcctggcctgaaatctgcttcttacttatctagttcatctcttgctatttgccaatgcaaatgtgggctaaaaccagctgaaacagtaagggcatgttagcagagggaaaaaggaaaggaaaaagaggcaaatagagtaagtacccaaagaaggaaaaagagcagagatcatagatggctatatgaggttcaggcagaggaattaaagaaagtgaagaaatggttgggaagaaattagaatgatgcctgtagactggaagcagtgaaggaaacaacatcagaaattggggcaaaagttaagaataggaaataagcttttactttttaactgtgctgcaaggatgcaaaaccaattaaattatttgaaaatgtgctttattttaggccaatctatagtatacatatcaaaacttagcttgctctggtgttcaaggtggctttatactgtttggctatcctgtgtttattatgccattaatccttttaactggtctggaaggcaatttagttttaagtcagttacttttttgaaatgaatcttatttataccaaacttctcatgtttgcttgaatttaatcaaatttttatataaagtgtaatttcaaggaatttataatggagcatcaagggaggagttggttatgtaatcatacttttgtaattttctattgtggagaaatttatctgcttagttattgaaatcaaattcctgcaatagagctattaaaatgggctagcatcatctttgagaatgttccttcttaaaggtaatataaattatatccaacaggagagaaaaagttaacttatgaggtgagtagactaagagtcattaaaaaaatcttgaggaagatttttaataatatgtaaaatatttctgatgtggtagcataaatatatattataggacattattaatagtaaagtgatccaaaacatataccacagggagatgacttgaaaaaaatgcattaatgcttcatcagttgttatcttagggtagtgggtaataggatagtttttattctctctatatatatttttgccagattatctaataagatacgtttttattaataataaaaagagagacaaatgatacaaattttagaatgaggactgctcagtctgcataaaaattattttcttgcaacaaagatgcactatggaattcaaaaatggtggtaactattgtcaaacatgtagagattggagttcctaactgttgcaggaagatctaagataaagtactacaagatgagtaacaaatacatccttaaaagcccatttaaggagttcttaatcgcaaaaaatttgaataggatttaatttgatgaatggtctagttaaccaaaatagtttatctggttcagttactgttgataaatatatttaacgacattgcaattgcatattattcagccacaacataatttcattaatgactcattaaaattattgtgaaaaggaaacacttaagattgcattggagcattgggatacctcacagtttgattttttcttcttcctctccctgcacattttttacttcttatatttaagtattctgctatgattttaaaaactagctacaaaggggagataacaaaatgagagccttctcatattaaaaaatatcgtttcttctcctaccccttatttttcagtgtatgttcacattaagaaactagaaaaatctagataagcagagccaaggtaattagttttctgtaattcttacacgaagagatcatcactaatgtcattttggtattatttactgagatttgttttttctacacttaaataggcacataaatacatgattatgtatttctcacactgttttatggcctgtatttcacacttggttttataatatgaacatcttccatgtcagaaaatattattcttcattatactaatggccaaatattattccatttgtagatgtatgtacttatttaactaattttctgtctcttgaagatgaattcctgcagtggaattgctgaatcaaatatgtatatattttgatgctttacggcattaatacattttcccttaagaaagttgtatcaatttatacatctatcatcctcagttaggtacatccttgctgactttgggtggcttttttattctgtttcccatttttataagcaaaaatggtattatatcttctttaattctactggtaggttgaacttttaaacatttaactatactgtatttctcggatctcctgccgtgtgtgtgtgtgtgcatacaccccctgccccccccacaacatacacatacaaatacatatttggactttaaaaaacactatgaacttgaattttttggttgtgtatacaccagtttctaattgattagaaaaatgagaaattctcttttttttaagtatataggaactaaatcaaaatattgtgaaacctgaaaagaaaataccacaaccccaagcagaaagggcttagttagctttaaaaaaactacatggttgttaaacaaggcttgtcaagctattaaaaacaagagtaacataaaacttacaatttctaaataggaccactgtttctaaatatgttaagtggtgtttaagtcagttaaatcttacagccaaaatgttgtattaatgcatgagtgagatgcattatagatgacttgataataaagttatgtatgtttacaacagagcattttgttcttagaacatagtgggagcctgaagtcttgggattatccatgatcataattgaacatatgtttagtttactctgggcaccatattttcaaagggacataaatgaactagagaatgcttaaaatgttgggacatggttaatcatagtgtcacatgagaaacgtttgaagaaaccagggataaaaaaagccggaatgagttaagattcaagcatggcatcattatatacaaatgctagatgagctatcaatgcagatttcaggttttgattgtacccctgagatggattaagcgtttgtaggtagaagtatgaagaatctaaacagttttgtggagatattcgtagttagatcaaacattcccctaaaaatgttcagggcacattgtctcactggaactctttgttcagaaactgaacatttacttagcaaggcttgttgtagagatgattttatcatttgatggtagttgaactagctaagttttacactcattttcagccctgaaattaaaacaaacttgaacaactggaggaatttatgccattatacacattgtaactctagcatacaatgcgtgaaaaatatgctagtttttttcatagcacattttaaaactgaacatttgaaatgggctgtgtataaagataaatgaggctgggcacagtggtgcacgcctgttatcctaacactttgggaggccgaggtgggcagaatgcttgagctcagaagttccagaccagcctaggcaacttagtgagacctcatctctacaaaaatcaccaaaattagcagggcatggtggtgcacacctgtagtcccagctacttgagtgggctgaggtaggaaggtcactggtgcccgggagatcaaggctgcagtgagctgtgattgtgccactgcactttagcctggatgacagagtgagaccctgtctaaagaaaagaaggagaaggagaaggagaaggagaagaagaagaagaagaagaagaagaagaagaagaagaagaagaagaagaagaagaagaggaagaagaagaagaagaggaagaagaagaagaagaagaagaagaagaagaagaagaagaagaagaagaagaagaagaagaagaaggagaagaagaggaggaaggggaaggtgaggaggaagaggaagaagaagaaggctgatctgattgactttgtgaactatttatattcatctattgttgcttgtattacattgcaagaatacaaaactaataaaaatgtatgaacttattgtaaacttggtaaattgagaataaagatctcattttttttgtgttaactttataagaatctgtgagagccagaatgatttcagacactgatgacaattttaacagaaacataggcgtttcacaatgcagtgggaaaattaatagcagaattagaaaataaattagaatagatattagttgaaataatctgaaatgcatttgaaaggaaaataaggaacagagatttcttagtccatttgtgttgctataaaggaatgcctgagactaggtaatttacaagaaaagaagtttatttggtttacagttctgcaggttgtacaagaattatggtgctggcacctgcttctggtgagggcctcaggctgcttccactcattgtggaaggtgaaggggagccagtgtgtacagagatcacagggccagaaggaaggaagagagatagaggggaggtggcaggctctttttaacaaccatctcttgcaggaactaaaagaggtagaactcactcactaccatgaaaatggcactaagccatttttgaggtatctatctccctgacccaaatacttcccattaggcccctccttgcaacattgaggatcggattcaacatgagattttgaggagacagacatccaaactatagcaagaggaagttgctataaaaacagatcaaagaaattgggaaagattgcaacacactgagatccttaaacagtttccatttcaaatggaatagataaagccatactaagtataaaacaaaatataatgaaaatgtatgttatcaaataagtggaaggattgtaagaagaatatgaatctggaaatcagaatgaaagaaaacaatacaagttttgttttgttggtaggaaaatgttggctggaaaatgttaaataaagatataaattagagaaaagagggatgtttgtcttgaatgttcattcagtgacatagggaaggtggtgaaaagcaagaaattccaaggaatagagttaaatgaaggcattttatatgagtattaaagataggtagcgaaattcaaggtacacagaaccatcttaaggtctgaaaggccttaaaaataatccaatcccatacccagtgaatggagcttggccctatattcttgagaagtgcttgcttagtatagactcaaaagtacatttcttataaggctatacatttatagttttaaacagcttcccaatgcctatcatacattcgctttagaaatattttagaaatattattttaaaaagaaatattttagatgatttctaacatgaatgatggagtgataggtacagggaaggatgagagaccaggtcccctaaaacccagagagactaaatgtcatttgggacttttgcacagaaagaggagcatggatttgacctatgtttctcattgcatagagatatcctaggaagatttcaaaacttttgtatgtttagttttctcatctgtgaaatggcgataataatagtatctataagacagagtttctataaggattaaatggatagtatatgtgaagaccatatcatggtgcatggcacatttatgatgttcattaaacgttgctgttaatatatgagaagggctgaagacatctgctttaagtcagcatttattgaacacagttcaggggaggaagattggattacataagatggtcttcctgtcccttcaaatcaacttgggatttttttttactttgggcagctacctttcaaccttcagtgcttcccgcttccccgtataaatataagagaaaataagataatgaagaatgaactataaaacaatttagaggcttcttgcaactatatctggttttgatctctttctaattttattccacttactgcatttctaagaatagtcattgatgtgtaagttattacgatagtggctgaataacattaaaaatattttatcatgaagtagttctttctagacatttgatgattgaaaatttcatactacctctcggaaacttggaggcatagttttcagggttacagaatgttcattattagtatttagtattttttagattaaaattcccatcttagggtgtaccttctctgagccagtcattttcttagattttgaaacttttctacacctaacacgatggagtaacagggactggatttatctttctgcccaaaataacaacaaaaatgtgggaaaaaatgaaacaacagtttctagacagtaaacaataacaagcagcacagagcattgatcccagaaacaggggcaatgaaagagacaagcgttagaattgtcctggcttacatttcaaagagagcttccgggccataatgcaggaagggggaagccaggtggatcctggaaatatccagagtgattatgagaaactgatcaggcttgtcttggtatgttatgacttgaataacactgcactaattgtgttttatggaattgacattggaacattcatatctttacatttatacgtacaacacctgttaatgaagtacttagtaaggtctgtggttgcagttacaggggaaaatcattaacgatgatggtgaagcaagaaaggctggataaaaagagagaaagacgatacgtgagacctaaataagtgaaaaaatgaggggtccattcaagagaatgaaaaagttcagtttgaatgaaatcacaattgtcaaatcagagacatgatgaaagaactacaggtaagccaggctacacagggtcttagagcatcttaaagatttgtgtattgttgcgagggaacaggaagccattgaagagtttaagcagagtgtgagatcattgagtatatactgctggggtctttggatgctaactagagataaccattaaaattttctgacttaaatctgatgagaggaaaaaacttatttccctttcaacagaaacttcgggtctgaactttgtagagtttattgtggctaaaatgaccacgtttttcaaagaaaaatcgacactataggattttttaaaatgacatgtgaaagccttacattataaattaaatcaccatctcatattcagctgcattttttaaaagaatccaactatatatattgagtgtcttggtcactttggtcctgacttatactgtagctgtacttttgaataactgcatctgtccatggccactgagaatctagaccccatcactgcagatgtgatgatatttttgttattcttatttctttgcttggatttatgtaaatttttttacccttccagcctacctaactacattataatttttttggtatcagggagtatataaaggctgtgttcgtccccagtgctaagtacagaccctaggcattcaatacattcttgttcaaatgaatcttatggagaattccaacccatataggagaattctcactattcaagaatttatctccaaattttcagcatcatttaaaaatgacaaataaattttgacatgcaattagactagcagagtcaccctagttacaactggttcctatcctctccccctttagatatttgaagaaaataaagtatgttaaaagaactcaaaataaatttttaattatgatattatgattgatgattattgaatgcatgctagcttttttccctactgtttattctatatttcaccataggataatgctaatataaaattattaaaggattaattcactgaagtccttatgataaagtatttggggatccctaaaattcttctgagttttaagtggcttatttgtgttgatttgttttgaactataatattttattttattttattttatttattaactttttttgagatagagtctcgctctgttgtgcaggctagagggcgatggcaggatcttggctcactgcaacctccgcctcccaggttgaagagattttcctgcctctgcctcccgagtagctgggattacaggcattcgctaccatgcatgactaatttttttgtgttattagtggagatggggtttcaccatattggtcaggctggtctcgaactcctgacctcaggtgatccacccgcctcagcctcccaaagtgctgggattacaggcgtgagccaccgcgcctggcgaactataatattttaatgccattttttacagtaagtaaaatattaatccatcacataattaaccgttaaaatgtctcatgcccattccctgtctcatttgtaaaaagtggtacttgtattgtcacttctacggcacttatctgtcccacacattttggcaacagattatttttcttctggattcttctctaatagtgttatatttataagcttgtctcttgcacaacagaatgaacttcacaagggcattggcttttcttctatctcttagtgaataattgtcacttaggatttattgaaacacagtaccaaacatgtattaggtaccccactgatatttgttaacttgaataagttgaatatgacaactttgttttgctttgttttattgaatttttcaggattatttgtatgcaataaaatgctcatatctgaagtgtacaatgtgttaactttttgacagccattaactactactcagataaagatatagtatatcttcataattttccaaagttcttttatgtcccttttaggtagtagtctccactgtaccccaggttaccacttttctgactttttatcccttagagtatttttacttggtctagaatttcttataaatagaagcatatagtatatactcttctttgccttcttttgctcaacattttaatattcatacatattattctatctatcagtagtgtgatctttttcaattccagatagtattctacagatgaatatatcacaatttattccattcttttgttgatggacattttggatgttcccagtttgggactactataaataaaacagttatgaatatctgctgcaagtcttgttgtggacatatgcactcatttctataggagtaaaactgctgaatgataggttaagtatatgcacatattcattagaaactgccaagctcttcttcaaagtgattgtcacatttacactgttaccaacaatgcatggaggtttcatttgtgtccacattcccactaacatgcgtattgttattcttttgaccttcacgattcttgtgggtgtatagtgctattgcactgtggtttaacaagagttcttgaggactgttgattgcagatacctaattttaagagaagtatgtgtaaattgtgcatttttcaaacatatttttgtacaaaaagcagcaattactttgtctccctgtgcctttgctattcatggaaaaacgggaatattagtagtactatcttatactgtgaccctgaagagtaaatgagataaatttagcacagtgccagacacatagtaatcactttatataaaatgttaactattattgtgagtaaaggcaatatattgttttttcatcattgttagtattattgagaggcagaatggcatagtatttattgcctgtgttcaaatcctggctttaccacttactaactaatgactttaggcaagttacttaatttccctgtgtctcagtttcctcatctatacaatgggaataatgcagcacctgtttcataagattttgtgatactaaatgagtcaataggtttcttggcacataataaacaagataaatgtgttggctgttattattactaacagggtgctgttattactttatatctttcttacgagtatatctctttaaagtagcaatttatttaaatgttttcattttagcatattgatagaatattaattttaatccagcaatccagtttacctaaatattctccaaaataaaagttgaaactttttttttaagtgtaggcagttctcttggtattgggtttgtgtcaattatctcttgctgtgtcacaaaccccaaaactcagtggcctaaatcattggccactaatttagtgtacaattctggaggtcagcagttttgactgggctctgctgatgtttaccctggtcttgaatgcatggatggtcagctctgtttctagcagttgagttgcttcagttagtggaagcatttgaaccatacatcttatcagccagccagctttccctagcttgttcccatggtggtgaggcaggccaaactgtaaagagcaaagagcagaagcaaggtctctggaggcccagccttagctcttgtgcagtgttgcttccaccatgttttattcctagtgtaaatcataagatttagggacctgagaaacagacaaaacctattgatgtcaggagctgccaagttacattgcaaaggaaaggcagaagagttgtgactttttttttttttttactgaatacctcactcaagagcttgttaagaataggctgtctctggggtaggtgcggtggctcacgcctgtaatcccagcactctgggaggccaaagctggtggatcactcgagctgtgaagtttgagtccagcctggacaacatggcgaaacccagtctctgcaaaagcatacaaaaattgctgggcatggtggcagacacctgtaatccaagctactcgacaggctgagatgggaggatcgcttgagcctgggaggcagatgttgcagtgagccgagatcgtgccactgcaccacagcctgggtgacagtgagacctgtttcaaaaacaacaacaacaacaaaaaagaataggctgtctctaattctttctttttttaattattaatatactttaagttttagggtacatgtgcacaacgtgcaggtttgttacctatgtatacatgtgccatgttggtgtgctgcacccattaactcgtcatttagcattaggtatatctcctaatgctatccctcccctctcccccaaccccacaacagtccccggtgtgtgatgttccccttcctgtgtccacgtgttctcattgttcaattcccacctgtgagtgagaacatgcggtgttcagttttttgtccttgtgatagtttgctgagaatgatggtttccaatttcatccatgtccctacaaaggacatgaactcatcattttttatggctgcatagtattccatggtgtatatgtgccacattttcttaatccagtctatcattgatggacatttggtttggttccaagtctttgctattgtgaatagtgctgcaataaacatacatgggcttgtgtctttatagcagcatgatttgtaatcctttgggtatatacccagtaatgggatggctgggtgaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgatcgccattgtaactggtgtgagatggtatctcattgtggttttgatttgcatttctctgatatccagtggtgatgagcattttttcatgtgttttttggctgcatgaatgtcttcttttgagaaatgtctgttcatatccttcgcccactttttgatggggttgtttgtttttttcttgtaaatttgttttagtttattctagattctggatattagtcctttgtcagatgagtaggttgcgaaaattttctcccattctataggttgcctgttcactctgatggtggtttcttttactgtgcagaggtctttagtttaattagatcccatttgtcagttttgtcttttgttgccattgcttttggtgttttagacatgaagtccttgcccatgcctatgtcctgaatcgtattgcctaggtttttttctagggtttttatgtttttaggtctaacatgtgagtctttaatccatcttgaattaatttttgaataaggtgtaaggaagggatccagtttcagctttctacatatgactagccagttttcccagcaccatttattaaatagggaatcctttccgcatttcttgtttttatcaggtttgtcaaagatcagatagttgtagatatgcagcattatttctgagggctctgttctgttccattgatctatatctctgttttggtaccagtaccatgctgttctggttactgtagccttgtagtatagtttgaagtcaggtagcgtgatgcctccaactttgttcttttggcttaggattgacttggcgatgcgggctcttttttggttccatatgaactttaaagtagttttttccagttctgtgaagaaagtcattggtagcttgatggggatggcgttgaatctataaattaccttgggcagtatggccattttcatgatattgattcttcctacccatgagcatggaatgttcttccatttgtttgtatctcttttatttcattgagcagtggtttgtagttctccttgaagaggtcctttacatcccttgtaagttggattcctaggtattttattctctttgaagcaatttaattatttcagtggaagttactaaagaacattgaagtttgttagaaaaaaagaggatgtcactgtaatataccataattgacaagtaataactatttgagtactaactggaggagaccaagcttaaatggttattcctgggaagaatgatttgtctcagggtgcgtagatacaaatgttaccaacccaccatgacaaagtttaggcaaatacaaagagcaacactaactttgatattgtatagaacaaaagggcacaagaagaataaaatggtccacagatattgcaggtgacatgtactatatgcaacaggtgtttgtttaggttatgttatcaccctttgctctgaaaaaaaaaaacaacaaaaaactataattccaatgaggtagaaaattggattgtaacagaaaactcacctttcagatgttcttgaaagatcttcaatgtagtattctaaaagttctattgaattattttaaaccatgttatttctattttcttctgaaaagaactaggtgacattaaagaagtctggatagaggaatggaaacaatttcaaaaagtctttcttcaggcctttgatcataggcattattttcaatttggatgaactggggtattctgactacctaagaagtctattgtcaaaatctgaatttattctgcaatataaattcagtttgggtactttaaatgtcaaccgtaatgtctttcaatcagtttattactgagatttttccagatttgatgtgtggtatcaaataacttacattatttgcaactatgagaatgcacagaaagcttcgtaatttacatctaaaaggaatgcaggacagatttggttttagttttattttaaaattttcatcagaaggaaatcatctgtatacatcatactgttgaatatttccaaatgatgttaaacattctgatgctttaacaattacattaaaaattacagaattgatttaagattgtgttaagaggttatgttgttgcttttgaaaacagtgagataagataaatcagattccatctcctcagtgctgcctatgctgacctgcctatataaaatagcaaatcccatacatcgtctgtctgatttcaccctgcccatttaatccccacgcattttagacttataaaatactgtatatttttcttacttgttatttttattttccgtctacctacaaataaatttgagcttcatgcgaccagaggtttttgattgttatgtgttttggtttgcttgtttttgtgtgttttgtttgtttgttttgttttgttttcttttgttttgtctgagacagagtctcactctgtcacccaagctggagtgcagtggcacaatcacagctcactgcagcctccacctccttgggctcaagcagtcctcccatctcagcctcctgagtagctgggaccagaggcacatgccaccacacctggctaattcttataggttttgctagagacagggtttcactatgttgcccaggctagtgtcgaactcctgagctctagcatcctgcctgccttggcctcccaaagggttgggttttcaggtgtgagccagcgtgcctggtcatctgttatgttaagtgaagaatacttagcagctggaagagtgcttggcacaaagtgaacactaggtagatgttggttgaatgaacaattaggttgataaatgaaggcatttaattaagaatgtaattagtagcaaatcacctttaaaaatatatctcattttatgtttaaaaataattacaaatgtataattttaacctcctcctttaaggttcttgtcgtcttgtcagtcgaattaaaatctagccttaacttttttcttgaaatttaacaggcttattttcacacctggcttttgttcttgtagttgtaattagtcagaattagtatattaatttttaaacacacactacctcatcttttgctctacttatcaaattatctaattaaaccttgaattttcagaaaatagtttcccaattgcattctgtgtatatcaaaatgcccttgaaaaaaatggaatttgaaaatttctttcttctgtcccccgactcttgcctctttcttagtctctccgtccatatatctctccttttctctcatacaatttaatagagaatgaatttccatctttggtacattcatattaaaaatctaatgccacatatgtggaggaaaaatcatatagctacatttcaaccaaaaaagtattgtgtatgaaatatatattctatagtttacttagtgaatgttattcctgaagactacaagtggcagcaaagaaattacgtggcatatatgtgtagattaagcatggaatgagtattgttttaaaattaacctattacctgtatggccatgatagtttttgtgaggagtaaattaatgcatatatgggagaaggctttgtaacatgtgaaacacttggtatatgagaatttgtattgaaatgattagacattaaagcatcttgttcataaaattttgataatcttcttttagccatttcttcaaagtcacttctatttttgtcaaatttcacctgtcggggggtttttagcttctgacctcagtattgtttcagtggctgagattaaacagcattctgacttgtacacagacaagtaactgtgctaatatccagtgaaattgaaaatggacaggaaatctttatacagctaaggaacaaataaatgataagagaattaatccagcattattgttcagaaaattaaacacttgagcagattaacaaaacacattataaaatttggattatttgtgaagagttgcaacatttggggaatgtttttattaaatgaatcttttattttactggatgctaatgaaaacaaactcattattttttatttggggtacgagtgttttttggtgacatggatgaattatatagttgtgaattttgagattgtagtggacccgtcacccgagtagtgtacgttgtacctaatatgtaattttctatcccatacccccaccctctttcttctgaatcttcaaagtccattatatcacactgtctgcctctcaagctcatattattgaagacttttccctataattttatattatttttatgccataatctgatgcttaatttctattttatttattaagtatgtttattttagggttaacattcataatgatcataaaaatcaggtaagctacagtagatgtagaaatttaacgtgtgtacacaacagaatatttcatgaaatttgtgtttaaaaacttgatttacatgattaaatcatttatgtagttttgaaatcagtgttatattctcctcaaaataaattgcatggaagttttaataggaatctcccacatacagtataattatttatctaaaacataatagtaaatatgtttataaattttactcaagtttaaatataaatagcgtttaccgcattaaaatatgaatttatcttattttattacatcaaattgtttgtcagggtcatattttatttagcgttccactaatgactacttgaaataaatcagagaaggtaagtcccataacagcttatgatctaggtcagtctcttcagatgaagataatgaagtgatttgaaaaactgactctattactgaatagtggtatgcttacttgagatagattatttatagcccctgcaaacaagagcagagttattttatattactgagacattttgaacaagaatgttagacagagtgaattgaataacttttcttaggatttagctcattttctatcatttcacatgtgttgacttttaaaaatctatttttaattatttcaactggcaatttaataaatacatttgcataatgtcctgaaagttcagggtagatttgtatgtgtaacgttctcaaaatagaggggagaattgttgggaaagctttgcatgttttatcttaagcaatactttttccttaaaaccaaagacattgaaaattacagccacaggtggatgtttgttttgagctaaaatagttaacagtctcatttatgagtccttgctctttccatttagccccatcaaaagggatgagtttatttacacagtgaccgtcttttttttttttttttttttttttttttttgagatggagtcttgctctgtctccaggctggagtgcagtggcacagtctcggctcactgcaacctctgcctcccgggttcaagcgatttccctgcctcagcctctcgagtagctgggatcacaggcgcgcgccaccatgccatctaattttttgtattttcgtagagatggggtttcaccatgttggccaggatggtctccatcaacagaccttgtgatccacccacctcggcctcccaaagtgctgggattacaggtgtgagccaccgtgcctggccgatccttctttatttttaataaaatctttaatcagagaaacctggaaaatagcatgaaggcgtgtccatttggtggcttccagataggaacttgatttacctgcaggaagtgacagcttagtaaatgatccttttgaaaatattgctgttattactctttaaatccggatttgtattaagccatccttgctatgtccttgatccttctttgaatccattgcagactgaaatatctcaatccgccagatgttctggtactgaacaatagctgtacaataataatgatacaatctcaaacacatcacagatgcactgttagtatccattactgtagaagaaaaaactttgttagcacacgctaattacttctgtgatggggaggaaaacaaaaatccatattaatttatatctttatggtctgcattatatttcttcatgaataatctatcttaaccatttattaaactatgaatacatttttataaatctggttgacatttaggtattttattaaacacaataaatgccagaggaaattgaattaagaaagcttgtaatacgctttactactagttaaaaaaaatttgtagctgtaaatggttctgctctatatcaagaataaatctgttcccagaccacagaattcttgttctttttcataccagaggccctgatcttttttgttgatagctggtttttaacagcttcaccatatgttttattccttttgatttgtaagaaatttgattatcagccttgaacagaaatcataatcacagcaaaaggaggcaagtaacttggggaataatacagagtcatttgaacagcagtgtgaagtctgagtttaactgactcagatgcccactctagtagagcactcatcagacttcagaccgaatccacttcggacagagaagtctccataaggtattcagactggcttcccctgtctttaaaacaaataaataaactctacttaatataataataactgaatttaagtatttccacagattagcaatttacgtgagagaaatcagcaataacatcaagcatatagcctgaaagtctgaaattgatgagagggatacaattggagccactagttattaatcatacgtgtgtatgtgcatgtgcacgtgtgtgtgtgtttgtgtacaattctgtctaaattggaactgatcttaaacccatttatatttttttgtggcagaaattttatgaggtaggcagggtgaaggaaggcactattaactttgactttataaaacttagaattgggctgggcacagtggctcatgcctgtaatcccagcactaagggaggctgaggcgggtggttcatgaggtcaggaatttgagaccagcctggccaacatggggaaaccatgtctccactaaaaatacaaaacttagccggcatggtggtgcacacctgtaatctcagctactgaggaggctgaggcaggagaatcacttgaacccaggaggtggagtttacagtgagctgagatcgtgccactgcactccagcctgggtgacagagcgagactccatctcaaaaaacaaacaaacagacatcttagaattgtttggctctacgttggttatgtaatttgaaacaaatatatgttgtgggataatcttaacgtgagctaactggtatatattaactaaagtcgttgaaatatttaattttgaaatgcaataatattttctcaaattaatgctcccgcctgaaaatctgtgagccagatagtaataattaacttctacctctacctaggattcctccacctccaactattttatcattggaaatgcatgaaggacaaacaactcaccatttctgcccactttagatgctaaggtgatattgatcactttgtcccatgtggaagaacatctaatgatatgttgggatgtctcatccataagtttattagtcaatcttatgttttatttgtacctagcaatgccaagcacactgtatgtgcttcattaatacttgtgaataaatatgtgaatgaaatttcaaaaaccatgaggtgcccttttgtggattcaatatgttttgtataatggtggagccaccctggaagaagctgctttgtttacccataacagcttatatttattgtgtgagacattgtccttcacagtttacatatataatgatgatatagtcttcaagagtatgaagtatagatactgttaacatctgttttcagataaggtgctggcacttagaaaagttaggtaacttttcaatcattccagatttcctaagacatagagccatggcgtaaatctgtgcacttgttttaaaataatacagctttattgagatgaaatttatataccatatagtttacttttttaaagtgtacaatttagtatattcagagtgaataataattataatactaattcatcattacaatcaattttagaatgtttttatcacccctgccccccaaaattgcttccactcgtttcccctattcactccccaacccagctctggacaaccactaatccactttctgtcccgacatttcattaaatggaagcaggcgatatgtggttctttatgactgacttatttcacttagtctattggtttttaaggttcaccaggttatagcatgtatcaatttctttttattgcagaaaaatattacattgtatggatataccacattttatttatttattcattagatgatggatattaatcaatgctcatttgaccacagctgtctgttatctgtctttctcatgactttggattaaattactactatagcaggtctctcataccttgcaatttcagcagctccgttgttcagcgctgctagttctctttcagcactaccgcagaggacagctccaagtttatggtttctgagtcccacaggcgcctctgattctgcctagctgagatcctcagagaggtataataaagcaagcaaatctgggtaggagcacagcgactttccctctgtctgcaggtatttagagctgattgtatcctcagaatactgtgtaaacggtatattttgtgtcacaatagattatcacctttggatttttcattttcaataggaattagattatggcatctttggttgagtgttatttagatttcctgtaaatctaggttacatataagtaggtaagatgcacagtgaaattcagtccatctatcttttgatgggttattcgaagtagtagtattaaggatcatttggtgaaattacttgttcattacattgtaatgggaagttagaagccaatatgtaagtagataatttcttttacaatatattttcttttcaagtttagatttatatgcttattaactttatccttcatatcaaattaaatttgttattgaatgccttatgtaataatcatgtagcttagttacaatgctcaatcttctgtcataaggtatatttgtatacttaagaatgaaattaattacacgttataaacatcacagtggaaaatattagttggattattaatctacaccatttacattctatgaaacatatttagggccagattctattagtacttttaaaaattttacatgatccttgacattgattatgattaaagacagaccaaagggaggaaaggggtgttatatcacttatgaggaagacacttaacatcttttcgcttgagttcacaacataatttagatgaaacactgttggccttggtaattaggaaaataataaaggcgaggagttggctttatcacattgtgtgaactgacccaacaataatgtgtcagaaatacagcatattcccagtttgtttgctcaacagaagcagataaacagaaggagctttctctaagccacatacattacaatggagacataaattacaatggagctttttccattgtaatttatgtctccattgtaatgtatgtggcttgggaccattgtctttgtaataatctggtaagattgtatcttttgaaaacatcaaatgtgttattttttcaaagtgatttggccaacggggaaattatgcagttatttatttatttattcataagccactaataagggcaaaactgagattctaaaatgattagaataataataagggtgttaaaaagtgatttttcacttcctatggcaagcagaattcacttataggtccatttccctggtgctgctatgacctttatattcattttatgctcagagctatcaattgttttcaaatgttgacacttgaaaaatcgctgtatgaatgatcatgtagttcccacagttattggtgctagaaatttctgattctactctggcctgggcagctgtcagcctagcatggcagtaagtagctttcttacctattagagaatgccctcagttcaaagaaaggagacatatgtgacaactgagagggttaattgttcctataaatgaattcattgaaaagtatttcacagcacacttgtttcaggcaagtctctgagaattattttatttattgtttttttggttgatcatgaccttttattgtgtttatttgcttaatattctgaatcaacctattgctgaatttctaagtaatgtactttattagttgctaaatttaacttatcctttcttatataccaatgatatagtttccaaatcttagattcttcttgaatagtactttctctttatgttgaccaattcatatactatactttgatgaaattatttttgtgaatcttctttttttctaaatgagatattcatgtatgataaacataacctttttaaagtacgcaagtcagtggtttgtagtatattctcagattgtgcagccattatcattattaaattccataatattttcaaaaccaaaggaaacccaggacccattagcagccactccatatttacctgtccatcaactcctaacaaccaccaatgtacaatctgcctgtatagatttgcctgttcaagaagtgtaacacaaatagagtaacattatatgtagagttttgtgtctgacttctttcagttagcatgacgttttaaaattaatccatgttatagcatgtatcagtacttcacttatttttatggctgagttatatttgattctatggatatacaacattttgtttattcattcatcatttgatggactttggggttgtttttattttttgtaattataaataatgttgctttgaatattgtgtacaaggttttgtgtggaatatgcttttattttgcttagatgtcctaggagtggaattgctgggtcatatggtaaagctatgatgaactttttgaagagtgataaatgaaactgtttaccaaagtgtttgcatcattttacattctcagcaacaatgcatgagggtttttatttcttcccattcttgtcagctctatatgttgctagatttgtggttgcttgttttttaactatagtcatctaagtgaatggaaagtgtttctcattgtggatttgatttgcatgtctctaattgctaatgatttgagcatctttcatgtacttgttggacagttgtgtatcatctttggataaatgtctgttcaaatttttgtctattttttaactgggtcttttttcaatatttaattataagagttcttgatatattctggatatattttggctatgtagtctaagtcgtcagacattgttttttttcaggatgtttcagttacttggagcgtcttgaatttccatatgaatataaggaccatctttataatttctgcaatacaacaaccttaaacttttacaaggattacatagaatctgtaaatcaatttggaggtattgcaatcttaacactagtaaatattccattccatgaacacgggatgtcttcccatttatttaggtctttttaaaatttctttcaatgatgttgtctagttttcagtgtacacatctttaatatactgattttattaaatttgttcctaagtattttattatttttgatattttaaatgaaatttttttatttcatgtttgaattgctcattgctagtgtatagaaataaaacttatatttatatattgaacttgtatcctagaattttgcttgaacttgtttattaaatctaaaattttctgtggattccataggattttctatgtagaagaaattgagatagttttgttcattccttccaatctaggcacattttattttattttatttttcctaattgtcctagttaggacctccactacaattgaattgaaatagcaaggccgggcgcagtggctcacgcctgtaatcccagcactttgggaggctgaggcgggcagaccacaaggtcaggagatgaagaccatcctggctaacacggtgaaaccccgtctctactaaaaatacaaaaatgtagccgggcgtggtggcgggcgcctgtagtcccagctactggggaggctggggcaggagaatggcgtgaacccgggaggcggagcttgcagtgggccgagattgtgccactgcactctagcctgggcgacagagcaagactccatctcaaaaaaaaaaaaaaaaatagcaagacaaccattcttgtcttctttttgatctcacgggaaaagctttcatcttttactgataagtatgatgttagctgtgagatgcccatttctgcaggtgcccttttttaggtttaggatcttccttccaaggattttcctttctagttccttgagtgtttttttatcatggaagagtgttgcattttttaaatactttttatgcatgtatcaaatgatcatgtggcttttgttctttattgtattaatatggtgtgctacattgattgatttttatatgttgaattaatcttgctttacttgaataatctggtctatatcattgctttacttgaataatctgttgtggtcataattctttttatctgttgctagatttggtttcttgaaaatttttgtgtctatcttcataaggagtattaatttgtagctttcttatgatgttcttgtctggtttgggtatcatggtaataatgggcttatgtaatgagcctggaagtgtttctttgtcttctagtttttgaagaatttcaataaacattttgtggaatgtaccggtgaagccttctgctcatggacttttttatgagaagtttcttgattactaatttatttactttccttgacacagggttattcagattttctgtttcttcttgaataaatttcagtagtttttgtctttctaggaatttttctatttttgtctaaattatctaatttgttgataacgtagtggtttatagtaattgccttataatcctttttattaaaatatctgtaaattctgttgttatccccccttttattctcaattttaggattttgaattttctcaattgttttgtcagtctagctaaagttgtgtcaattttatttacattttctaagacccaatttttgttccattgatttttttctgttgttttttgtttgcaattccctttatattttactccagtctttattattttctcccttctgttgctcttcttttccagggtttcaaggtggaaagttaagttattgattttaaatttttattctttttaaatatacgcattcaaagctttacattttctttgaagcacagctttagcttcatcttttaagttttggcatattctgttatcattttcatgcatctcaaagtctgaaagtaatttcccttttgatttttttcttgaccccttggttatttatggataagttatttattttccacatatttacaaatttcccaaatttgcttttagttttgattgctaatttaattttattgtggtcagagaacgttttatgattttattccttttaaactcattgaagtttgttgtatcattttttatattatttataaaaccgttaatatttcaatatctctaaaatgtaggaaaaatgtatataaaatatagtctgtagatcttttacagtctaagttgaaaaatgttttcaatgcacttaagaagaatgtgtattctactgtttggagtggagtgttctatacctgtttgctggtctagtttgtttatggtgttaaatcttctggatcctttttgatcttctgtctgattttctttccactatttaaagaaggattttgaagcttttcaactattattgttgaattttctatttcttctttcatttctatcagtttcccttcctctattttgagtctttgttttttaggtgcgtgtaagtttataggtattattttttactggcagattgacccttttctcattataaaatctgttcatctgtactaaaatttttggcttaaagtattgaagtgtgatattagtaatgctgttccagctctttttttggttactgtttgcatatgtccttttctgtcttttaactttcagcctgtttttgtctttgaacctaaaatatttcagttgtagacaatatatagttagatcatgtgttttttaaaagccagtgtataaatatctaccttttaattacagcgcttaatatatttatatttgctataattacaaagtaatattgatgcctgtgtttcctacttgttttttatatgacttatttctttttgtttgcgactcttgtttcttccccatttccatcaacatccctgcagtccaggccttcacatggcagggaaatgacagatgtattataccctgtttaggtaattgttgccatttcagaatggagtcccagtgatgcttggtcttttaatatatgagtggaaatcagaatttttaagtttttggaacacttcaatattttaatgttgacaactaatagagtttttaaaaaatacattagacatagtttgtggaacaagcaagttatgtctaatgagcacatggaatcaaagagaaaccatttgccacctctgttttccacatgtggaaagtctcaggaccagctcaattctggcatgcttgctttcatatatgttgtttactgatacttacataaatatttcctatctgtaaaatagtgggaaatagaaatagtaaaagcttacttgtattaaatactttatggtatgctggtgatgtttatgtccctacctctttttatatcaacttattttagttttcaggtggaatatgttcaaattttatcagactccaatcaaatactgcagtagtttctaagtcttagagctgttggtaccagatggatggatggatgaatttgtgttctcatgattgagacattacgataaggggaaagagtattacagcaacagacaaatgacttggctttagccctcaactaatttattgggtgcttttcaagtttcctactcttataaacttcagttttctcttctataaaatgaaaagattagccttgatcatttttaaagtcccccaggctaacattggctatgactgacactgtggagctatgggatctgcatgagaaatttttctcagtcagtacagcatgcacaagggagaatggctttattttatgtcacaatgcagaatgtctgttgtttgctatccctaaaagtgatgtcctctatgatttacaaagcctatggagacatttgcagcataagggaccgccttcccactttttcacctcagcacatgctacctcatcacactttctccttatttttagttttatgccatcatctgcaggtaatgtttgacctaaaacctacaccattacttgttcccttttaaaaatggcttcacttgtaccccaatggcatatcgagcacctgtgagacttcaggtgttgtttgatagtttaactaaaattaccatgattatctgtgtatatgaaaggcttttaaccctccactacctaaaactcactcgttctgtgctctcacttgttttctattataatacagaaataaaaggattgcatttgaatactgaaaaattgtcttactgccagtgcttgagtgcacaaatccggttaactctcaaatgatagctattcaacctgtctttcaaagcagtagatgtgttttgaaaatttcacatttgatttataaacaaaaagactcccttgactttatcctcctgttttccagacttttttattttttaagaatgaaaaataacagctaaggaatgtggcctggaatgaaaatatccgaatcagaagcaaacagaataaaaacacacctacctttccccctgaaataacattaatgtcttattggatctgacaaaattcaatgaatttctaattaaagactgtttccccactcctgattcaacctgtcctgcctagcagtagtagcaagaatgagtcatagtctcttcagaaagtaaagcattgcagattgagttaatgatgaatttttcccccttgatttgaaatactcttgcctctgtctttccgtcaaccctagaatagtaccttgatttgtaattttatattgattttaatttgcttcattatttttcttgtagccattaaaaatatatcaaacagaatcatacttgacaagaagcataaagaaaccttccactgatactggaactgttgggttttctttctactgaagcttttaatgattctttgccaatctactttttaatcatctgaagtaaaagtagtataaagcgtgttacttgaagcattcttgacagagaatgcagctgtgcacctgtgagaacaaataactgatgttccttttggtcactcagcaggaatagcattttaataggtttcttcactgatccggcatgctaagagtagtttgtagtgtgcatttaatctactgtctgtataggtagctcattatgtcaaggaaaggcttatgcacatttataatactttgtaaactgtatgattagatcattatttagaaaattgcttgtatgggaaatggttgaatagaaacatgttttccaagcaattacgtttccttcttaaaactctttgtccttcatttaaagataaacagaacttcttaggtaacccttagatattttcctgagttatagagttttggaggattcttaaggatgtgtatctgacatattgtaagcacgtaataaatatttattaaatggatgaatgaaactaattaagaaaaaagtgagagtttttttttgatacgataaaacttttttttaagataaaaatggcactttgggaggttaaggcggcaggatcactgagcccaggagttcaagatcagcctgagtaacatagtgggaccttgtctctacaaaaaataaattagccaggtatagtggtgcacacctcgtgaggccaaacatattgctatgaccagtggaataccagtggaaagaacatgaatcacaacaggatggcaggttttaaaaccagttgctaggtctccttttattaatgttgtggagatttcagaaatgtttattaatattaaatagttttcatcctcctgaataattagggcaatcaaacactgccaaccaacatttgacatacagcataaaagtcaagtaaattgcatttatttttgctgttaatattggactatcactaagcaaatcttgctggtgtaaacttcttagtcattggccagtttgttacaaagatctatgaaaaattcttatcccagtgagccaggagaaacttctcccaggagatcctgaaatctaaagtaggaacacatgcctctctatgtgacatccattgtgacacagatggtttggtcctttccaataataaaaaaaatggtgcgttttggaatacttgtgctttttgaaactataaatcacattatgagtataaagaacacagcttttgaaaaaaataaacttttttttccaaatgttggagaaaccagtgtttccagttgattgacctaagatgggtgttttaggcccttttggatttttaaactgtttttacgtgtatgtttctgtgtgtttgtgtggtggcttgtatttatggatgtgtgctgttcgttgctatgataggaaataacattgaaaactggagttatatgttattaagaacataacaaaaataaaaacactgtgtgaaaatctgtgagttaggatcaaaaattttatcttcaggcaaatatatatagccttaaaaaagttatcacatgacatattgtaaataaaatgaagtaatgttcaacttgaaaagttagaaaagacaataaaactattggagtaagtaaaataattaaaagatgattaaataatgatcaagaaatagaaacaaaaaatagaaaacaacagaaaatagattagatagatccaagaactattacttaaaagcaagacgtacataaactgtttaaacgtcttgtacagaaaaacaaaaatatagtcattataagaaggggttatatcaatactgaagggattaaaaatattaaggaaaatggataatatttttatcaatgcaaattatataaattaactcatgtttaaaaacattaataaacaagataacctaggaaaagaaaccctgaaaagttgtcatttttacctccaaaaaaatgcagtgtgctgtcatcttaatggataaaccactttaaattattaacagataagcaattttatggtaaaaaaattgattcagaaatagaggaaaaactgaaaagtgtcctttaccaagcagcataattttaaacacctgaaacagaatctgacgctcagaataaatatcagggccggaggtggggtggtgattctgaaacccctgttagccattagccatgctcatacagtcactcccaactatatgtttgatatactttcttaaccattcctgactgaaaaacactatagagtaacaaaaataattagtagtgtagtaatagattgatactttatatgacgcaaacctaagacaatatagtacttaaggagaaagcatttcaggcatacccaccaaataccccccaaaataaaggatgcttcccttatactttgtttaacttagtgattcttaaagtttttctgtctagtaagagatgaaaaaggaataactgtaaaattggaaaagcatataaagttatttctgcctataagaaatatgattatgcccttatttatacctatgaatctgaaaactttaaactaaaaatacatgttttataacaccttttaaaatgtactgtttttatttaatttcagttttcttgtcaaaaacaaacaagagtgtacaattaaaattgataacaacaaagtataaaattcatatgaattgacttaacaagagatgtccaattcttatgtgacagaagccataataatttgccaaagaacatgaagtttcaataaaatgggaaggttaaatatgatacagaatttagtttcatgcacacacatacatatgtatatatattagaattctaaaattatcctgaagtacaactggaggaataatattcaagggtagccaagggagtttcgaaaataactaaaaaaattttttaatgaaatgtttatataatattagatggattagacaaatgaaaaggtcaagaaactgacctacatacatattagaagtgaatttctgttgaggttggcatttcggtgaagctgtataaatgtggattatatgagcatgatgtgataataggtgaaagggtagggcaaatcattatctccctgtatatcagatgaaactcagatttattaaggaataaatgttaaatatataattacaacagaatccaaacaaacaaggtaactatatgatttggggataaggtgagcctttctttaaaaaaaaggataaaatgagatatctatcgatttaatactgtagtaatttgatacaaatgtaaaagaaatacaattacaattattaacaaaatgagaaaaaatttgcaaatcttaaacggaaaaaaattgcgatatctctaaatctaataagcaaatgacatatcaattaagcagcaaaatatgaacaatcaattttgaagaataagaaatacagagagcttcttaacagcttcagtgttaatcaatgaactgttcatttaagttattatatcatgtttcaggtatcaaattggtaaacaggaaaaagaaaaattaatgcccactgtttcagaggttttcaataaacatgttattttatatttcctaagagtttttaatttaaataataaaatccactgaaatgtacatcaaaaagaaacatgcatacaaaaacaaaaggagctttattggaaatgtataggacagttcacagaattaaaagaattagctatgaacagctatgtagaaggaatttgaaagttagtcaatatcattgagcataaatcagctccattttttttttgcacgctataataagtaacttctcttgaaatgagaatttctagtagagaaagtgaccaattgatttaacttaggtaatttttgccacttgtatgaattaaggtgaaaactttagacgggctgtcttgttgacactcatccaacatgtattcatcagtttcccaaacgagaagtgggatgctgttatctgaagtaaagagaggcacttggtaggcgaaaacagtggatatccagcttggttattaataaggatgttaacagtattattttttttaatggtgggcttacgagatttctatttttctatttatgctttttgcttttttctatttttttcctcagaaataagactgttataatcagaagtaaaaaggttactgaaatatgtaactggagaatatgttgagacaccctgaactggcccatttttagccaattcatttttttaatgtgctagataaatttatgcgtcctagaatcagaaggctttgaatcaatcaagttctggttttaccagtaatgaacattagtaagacatttaactagtgttgagtcttggagctattaactagaaattatgaattatgttactatctatataaaacttttaaaaatttggcttaaaaaattacatccacatgtttaatatatttataaggcagaattccttgaacatatatatgacctttgatgaatgtttgttgaatattttcagagtttcttaatgccaatcccaaatatcacttagtcaaaaacttatttatcttgagacttctaacttctggtattatttggttatattgttaccgtttcttcactgaaaaaaatgtcacctcccaaatgtctcatccttgtgttttatttgattttgaagatgtgggtcatcttttatgatgaacacaggttctatttttatatcataatctcatgatgattatggtgaaatgaacaaattaataaatggaaataacagtagaatatttggtggattgttaatagatattaagtactctagcagatagagtcttttattttatttgatctctatatattaattcatctgtctgacaataaaatgtgtttttaaagacatgctttatcaagatgtatttgaggcatttccccccactgatctattgtacttaaaaatttttgaaagctcaaattacactaaatgactgcagaaaaagtcccaaatagtaagttgccaatttgaaacttttattagtctcaattagttaatttattgaactaatttaaatagatcaataaattaaggtttataaagaatattcgggcagtctttttcttaagagaatcctgcaagactgaggcataagatacagtctgttgatgtttttatccctttcatttatccaaacagtgtaaaacattgcttatcacattggtatgacttacaggattcaacagaacacttagtcttttgtcttcattttccccattgctttgtatttctttagatttaagttataattaacttgaatattaatcttagatggcatgatttgatatgttaaaacgaagagtttaagacgccgagctctgtggttctcgccttagtaatgtacacattacagttgccagttgacaggtttcatttatccatggttttctttaaaatgcctattgatgcaaacctttttaataagtaactcaaaaggaaaaacacacaccaattaagttgacagtgatcccatatatttcttcctctaatttcccttttgtgacttcattttccttcccccatgccttcctttctttctacatacatgcacactatcaccattctagtggcccctgcctttaggcaccatgtttaagctctcagacctctcttaaatacttgtaacactatcaatactacctattttgttagcataattgtatggactacatggcaaatatttctgaagcacactgtaaatgtctgtataaatgcaaggattagcgttgcccgctgaatctagacctgatggattatcataaagaagacaagtttgcatatctgaattcaattaacagtggtacttgtttgtgatggagttggggtttcatttaactcaatctcattaatttatgcaaggaccaaatttgtttagtgtagtttatttgttagaagaagctagcgggcagaggattcatcaaaataataaccaaaacactcagaaaaatcaatagctacttttcaactcctgatctttgtcctcacccagagtgagttctaagcaaaattgtgcaggttatcattcctggatttcgcgctccctctcacacacaaatcctgaagagcattatcatacccattggttcgttgtgcagtggatcaccgaggcatttctttatgtgtactctttggcctaccattccgttctaatggacagtcatagttcatagtgagtttgaagtctttcttctagttaatctgtcaatttttctcacacagtgcagctgctgtgaaagaaattggagctgttacactttgtgctttggtacagtttgtaaaatgctaggtaggagacaggaaaccaaacacagcatgctactaatttctttaaaacgactgatgtgctagaactcagagtctgtgtcccagagagctggcatccctttttttctgagaagactaacgtcgtttgaaagtgttatcttacttttgcatcaacgatatagatgcctttggtatgacttacaggattcaacagaacacttagtcttttgtctgcattttccccattgctttgtatttctttagatttaagttataattaacttgaatattaatcttagatggcatgatttgatatgttaaaacgaagagtttaagacgccgagctctgtggttctcgcctgtagttccagctacttggaaggctgaggcagcaggactgcttgggcccatgatattgaggccacagtgtgtgatgattgcaactgtgaataacttctctagcctgggcagggtaacgagaacttgtccctaaaaaaaaaaaaaaaaagagtatgtgtatattgatatgtaatcatgtgactagacccttcactgtatactatataggaaaagatatataatatgctagaaaaacacactataagaactgttcttaccagaaagtaagcttattccagaagaggttggccctgtctccatcaggaattgtcagaattacagggatatagcaaagtgttctttttgacacatcaggattcctttctcttgaatgaaatgactatattcttcttcattgaagcatttgtataattaatcaagatgtttgtatattactctcctcctaacatgtgagagctgcaggtattttaaatgagaatgcttcaggatgtgtagtactgtctctgtgtgcagatttactttttattttatacgtctggtttttttgtgtgtatgcatgtgtgttgtgttgtgtgttttcagacagggtctcccactgtcacccaggccagagtgcagtggagctcactccaccctccacctcctgggctcaagggatcctcctgcctcctcctcccaagtatctgggactgcatgtgcatgccactatgcctggctattattattattttttaatgtagagataaagtcttgctatgttgccaaggtttgtcttgaatgtctaagctcaagcagtcctccccacttggccgcccaagttggggataaccccacttgggataatccccaaaacgcccaaggttttgggattatagatgtgagtcactgcacctagctgtttattttacggaggggccagttaactaattccctcttctaataaaattgttttgtaaatccaaatttgttcttgcctgttactactatttagaattttgcaattttattatacctagtcaaaagaaggaaggacgattcaaaaggaagaggaaagaaaattaatattaatcaatatatatcaaatgcatactaggcttttagcatcatctcaaatattttatatatattatttaacattcacaagtaccacataagataaatattacagttatgattttacacatctgtaatatccagagatattcaagaatcatagccagtaagttggatgaacattgcctaaaaaacacatttttaaaatctgaaagccagaacacttaacccttgaacaacgttagctgcatgaatccactaatacccacattttttaaaataaaagttacaccaagggtgcctgcctttcctgcctcgccttccatctctttcacctctgtcaccccagagacagcagaactaatccctcctcttcctcatcctcttcagcctactcaacttgaagatgatgagggtgaagacctttgtgatgatccacttccacctaatgaaaagtaaatgtttcctctttcttatgattttcttaataacatttctttagcttactttactgtaagaataatgcatataagatacaaaatatgtgttgactgtttatgttatcggtaagacttttggtgaatagttggctattaaagttttggaacagtcaaaattaaacaccgatttttgacttcatgggggttggtacccctaccctcctcgttgttcaaggggcaactgtatattctttttggtgtatatagagaccctgtaaaagagaattaaactttttcaagtccctcatttgtaatagtaatacatgtatagcctttaacaattttaaagcgtgctcttaaagaacattttctttgcccatcataataaatgcttatattaggcattattacctccgttttacttgttaaaaatcctggacttctacaatctgtcagagttggagaatcaaaggagaaagtgccttagcaaagagaatatagctgaaacaagaatcaatcaggctgttggggatataattctggaatgaaaattagactgaatttgttcttaagcatctttgttgtttgagctctttgttttctcatgtttagaatgagaagtggggggatttaattacgtttagtgacctttcaagctctaaaatgttttgctacttgaaagtgtacttagatgtgttaatgttatatacagaaagaaactgactgaagctacttaataaaaagtaatcaagatgaattataacagaaatagtaatataagataggaaatcctgaactaatattaggttatgtgcctaaatttgtgatttttatttaaacctggccttaatatttggcttcatttacctttcccttttaacctcagcgtcccaccttaacatagaatcaatctatgctatttgctatgtatcccaggtggataactgttcttgtagttgaccttcataatgtaactttattggtatagttaaggttaatggcacattaattttctataagacatcagtcagtatcccattttaatttaccattttcatgatgactgctgttctaagttgtttgtgtcatttttggctgccataaattatcccgaagcaaatatcaatgtgaactcagaaccatgcatgctgatgacttctgaaattattaatgccagtacataggaaaaagaaatacatgagtgcacatttggttgataatttctttatagattaccattaacctctttctttaagggaacagcataagtacatctgtgtttatttgctctaagggaaacaacagttataattaggaataattataacagcagcagtgaaactctaaaaaatatcctggaattactatcattcctaaaatatttttatttcagtggaaacagccaccattaggatctcatgggagagttcaaagagaaatgatagattatttcagatagacccttgttgggtggctgaattctcagagtggaaatagcagataatttgggctctgttcaaagcagtctgaagaagctctgtcctatagctctgaagggacccattttaattcacagagcacattaattgttatcccccttataaacatgtctttgtttgaagcattatctcaattgtgaaatgtggcttagaacaattctagatagtatagtggtaaaaaacttcaactcaggagtcacatagatatgggttcaaatctcatctccaccatttattagccatgtacccccatgaaaattattttaaacttttagtttccttagctttaaatggaaataataaggctgtccccacagaactgtcctgagggttaaagaatctttccagagtgacctgtacttagtaaatagctcccaaaattgtggaattctgtagctgtttaaatgagaagagatttttattaagaggtttccaaatttgtcctctttagcatgccattattgtcactttcaatcacttgggttttcagtactattattttattattttttcttcatatcagctttaaatttattctcttttcatacttagtcttgtcaaagccagattgtctcggaggtcttgatgttagacgacctagtatctcaggtttctctttgtaaaacaattgaattaatacatggatgtggttaggaaagtcatttgtggtcacataaacttcagaatcctttatgtccagttcttctctgtcacttgggtattcctgttataagagagaaaggagtcatatttagtgacatgatttgaccttcatttttacttaacctttggtaagtaacagtgagctgcttcaaaatatagtagtatttgtgtattaaaaacccacattcatgatccttaatataaaccaggcactgtgggaaaccacaaacagaggaaagaacattaccaacacctgtagttatttattttatgtgctttggaaaataagttaaatgccctcaggagcagtgttcatacatgaaaaaattctctacttatgccacaaggtcacataggattgtctgtatgataaagtatacattagattactctatctattttgtaacactttatagctgtaaggttgtatttttaaacgagcaaaaatgaatcaaaatttaatttgaaagcagggactcaaacagatacttctgtatcaatgttcacagcagcattacttaaaatagccaaaaggtagaaacaacccacatgtccatcaatgtgtgaatggataaacaaaacatggtgtaaacataggacggaattttattcagccttaaagaggaatgaaattctgatacttgctacaacatggacgcaccttgaaaacactaactgactgaaataagcaagacacaaaaggatgaataactatatcaaatatcacatgtaaggcacccagagtagttaaattcagcaagacagaaggcataatagtggttagcaggggctggggagttatttttttaatgggtacagattttctattggggatcatgtaaaagtgttggaaatggataatggcaatggtgacacaatcttgtgaatgtacttaatgccactgaattgtacacttaaaagtggctaaaatgcagactttacattatgttagctctccacaataaaatgtatactgaattttaaaaagtgaacagaaacttagaaactaaaatactaagcatctaattatctgaaatatgctgttaagtgtctttttcttttattgagcaactagctgtgtgtatttaatattctaagatctttaaaatagaggaaaagttgctcttttcctatttaacattctaagatctttaaaatagaggaaaagttgctgtctcagattggtggatttcacattgatggaatactggaggattaccgaagttcactttcctgggggctctagttcatgtctgactcctgtcatataggcccaaaattgccatctcagctacacagagcctcagcttgataagcaaaggtatttttcttgcaagagctctcttgcctctggagagactgatctggaatgactgtcaataacaacaaccatatacctgaagaatcggtctcttccattttaatttcatagacatgcaccgctggaactatgattattacaggatgaagtctcctataggaaagccggctgagctaacaaaatcaagccccattagtctgtccctggagcacaaactctaaatggccaggggagggaaagtcacacaggagagggcaagtgattggaaattgtagaaaatgggagaacgttgttgcgtgccatggtctcatggagattcatggaacctggtaaattaaagtgcacatccgtcccttaaattgtcatgctgcttcaagtttacttaacttttgtacagacttttacagacttttagaagtatttgtacagacttttagaagtctctccttcttccattgcttgtagctcttagatttaaatgatcacctgttcttttttgtagtcaagttgggatgtgcccccaaacacgtaacatgttttgaaactaaacaaatatccaccattaaattaagtttctttgatgctttcttttttcctggcagaatttggtcaaagcaactatttcattgcaaccctgacttgaataaacaagtacatgcatgctcatatagctgtgtatactcatgtgggctgctttagtgccttgactcaaatttacattactttcaagtataaacaatacaatactaatacaaacaattttgggagacagtaaagtttagtactgggctctataatatgcttgtgtgtttttggaaatctgtaccgtgcattggcaatccagagagtgctggtggagacaggactaacacaatggttcccaactaaggttattcctagagaagggcttctcaacttcaacactgttcacattttgggctagataaatcttggttatggggagctctcctgttcattataggatatttatcagcactcctggcctctactattagatgccagtaacatctgttctcctctagccatggcaattaaaaatgtctccagatattgtctagtgtcctctggcggggagggggcaagaagagcagtttagagcatggcatgaaatcccaggggcagggtgttgggctaattcaaagaggcttagggttttgaagcagtgagtggtgagaggagaagaatgatagaagaaataactggatgtgtctgcagcattttcttcccatggcattgcttcttgtaagatacacacgcacactcacactcatacttttgttctacataacatatatattgtgtagtatgaagtttatgagttataacactgtcgtcagagttatacctttatcctatatccagaagcataagacggtaacttaaaatctgactgttttatctaaaaatgtgctttcttttgggtattgtcaggactcttggtttcagttttaatttctataaatccagagatttgaacaattcccctgctagcttctgtttctctttgtgtcccagatctgtttccctccatctatagccaggacaggagtaacttgattctgagaaccctgagcctaccccaaaaggtaaaggaatcacctttccctatgtccacagattaaaatgagaaaaacatttttgggtttgcttgagtcttaagtgttcttctgacctaggcacttctccagggggctggacaagcctggctcatctaatttctaccctcccctagcccccaactttccaacctcgcaaacaatcataaggagtgctccccccacctcaaaagcagagatgctttatttagtactctgaagacaaaatgaagctgcaatttctttttgaaaatcttccccccagtttttcattcccttattttcagtgagatattcatcctctactttaaatgtacattctcttatagtagttctcaaagtctggtcgaggaaacctgaaggggtagtgaaaactttcaaatggatgtcagatcaaagctatttttgtaataatactaagaaggtatttgcctttgtcactctcagtctctcacaagcatacagtggagttttccagaggctgcgtgacatttgatgtcacataagagcgaatgcagaagcaaataggaggatccatttgtctatgattaagccagacattaaagagagatttacaaaaatgtagaacatgctatcctcctcattattttttgctttatataatattttcccattgaacatgctatttatgttaatatgtaatagacttactgttattttatgaattgaaaagtattttagaagtttccattttaatttctaatgtagtaaatatcaataaacctaatccattaattaaaactctttagcattctccctaattttaagaacgccttttgtttttatggtcttacttgaatacctgagtcttcatcaagttcttgccacgatggcttttagaactccaacatttccagcccggtgaaagccacagaatcttttcagctcaagccctccagtggatgttcacaattaaaaatttcccattttttcctgtatttagatgtctctttgctgtacaacaaggaacttaccagcggtcactacacatactggattataggcaagatagccatttaagggtagcgaaaaatgtaagaatttttatttatatattttatgtgatttgaaacgattgtgatttatatttcattatgtatataacatcagtaatagagtacatatgtgtactttagaaataaaaatacctaattagaggtgtatgctttattttctaatagaaatatgctatcaacaaaagtgatacttatcctataatatttgagcctgttttggggaaaattataacttgatacagagtgaaaagaataaatatttcttttagaggatgtgatggttaattttatggttcagtttgactgggccacagagtgcccaaatatttgatcacattattagtctgggtatttctgtgaggatgtttctggatgaaattaacatttgaattagtagatggaataaagcaggttgctttcccaaatgtgggtgggccttatgcaatcagctgaaggcctgaatagaacaaaatagtgaccttcccctaggaagagagaatttccctgtccctactacctttgaactgggacattggcttttttcctgcattcagattgaaactgaaacattggctcatcctaggtctcacacctgtcagccttcagactggaaatacagcatctcacgtctactgggcctcaggcctttgaacttggactggaaatagactgtcagctctcctgggcctctaacttgctgactcaccctgcagattttgggacttgtcagcctccttaattgtgtgagccaattccttctaataaatttacacacacacacacacacacacacacacacacacacacacacaatcttactgattctgtttctctggagaactctgctacaggagattacacaaactgtaaaggaaatatactatcgcataaattaagcaatgatctctataacttcttcagtctgagaactcattccttctggtcactggatgccttacaaggacagaatagggaaataggttttacttgaagcaagaataggaatggctgtaactgtttttgaattagtactgtctgtgagcccctgggcaatgaaggtattattgtctccattttacaaacgcagaaatcaaagctaagaaagaatactttgcccagggtcctacagaagtaaataaagtagctagaatttgagccagcctttttctaactccgaggcctatcctcttactagttgactatccataaatcaattttctacctataaagcttccttggacttgagtatccataaaacaacttcccacctacaaagatgtaggtaggaaagataattttcaaagtgttttaaatgtagcattgcctaccctggagttcagttaagccacaactgatctgtggtaatttggggaaatttcatcaagttggtctagaattacagactcctgggaatagatgtgtgtgtgtgtgtgtgtttgtgtgtgtgtgtgtctataaagtgccaagcttattttccaaaaggataaaggtatttcccagtgagtaggaaatgtttgcattcttcatgtatttgtgcatggatttccaaattgatggattttgcttcaaaattagtcaagaaatcaatcctggaagttattgtgtgtgtagctcaattcagtaaagtggcaaaatattatttatttcatcctccttatgctatttagtttccatctcattcctcatggtaatggagaaatagtctatgatattgtaaacacatatggatctttaagatttattttatatttgttttagcgttcaggaggcacttggcttttgcatctctccctctttaggaaagaaaaccaggtcatgccttatattttatatatgttttacatgtatttcctttcaaaaatgtgtcatggtatacttagtccttccctttaaagaaaaccataatgcagatctcattaaggaacataaatagtgatacatatatatggaaaaggacacacattctttagtgcagtggtgggaactagtgatcttcctccaaatgccagaataaatagatgttcctagcaaaaagcagggactatatttggaacctcccctattctggagttccagatctgattactcatgtagaatctcctgtttcatatataggtgacagtgttcaggactcattaccccaaaacatggcatcttagcatttgaggaaacagccaaagcagaccatacaaactagaaagaattcccctcaccccttccccactgaagtaggtcataagaccctcatctggaggagtcctgacttatacccagaggaaagcaatatcacacatggttgccaagaagaatttgaacaaacagaatttgctaagttcttcctggtttattactgttatattatacccttttgtcttccaatcatacttctgcacggctgtccattaaaaatacacagttttggccgggcgtggtaatcccagcactttgggaggccgaggcgggcggatcacggggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgggaacccgggaggcggagcttgcggtgagccaagatggcgccaccgccctccagcctgggcgacagagcgagactccgtctcaaaaaataaaaaaataaaaaacacagttttccccaggtctttaattatgcatttctgaataatctcgcatcatgtaaaacttacgttaaattaattgtatgcatttctcttattaatctatcttttgttgtaggggctttagccatgaacattgataggagttagaaatattttcttccttacacgtatacagttggccctccatatccttgggttccacatctgcggattcaaccaactgcggatcaataatgtttggaaaaaaaaaacaataaaaaataacaaaaatgttaaaatacagtataaaatctatttacatagcattttcattgtattaggtgttataagtaatctagagatgatttaaaatatactggagggtgtgcaggagtcacatgtaaatacgacatcactttatataagggaccccagcatctgcagggggttctggaaccaatcccatgtggataccaagggacgactgcattctccaaatcctgggcatgggcataccatatttcttaacatagctgcttaccatctctaatgttgtctatttaccattttctataaatctactgggttttaaactaatttttgatatgaagaaagtttatatcaatataaatagaagtaaaatttttcacaaatggaaaataataaaataaaaattttcacaaatggaaaattaacataaaaataaatttgcaaatatttacaagcgtaacataaatacacatcaacttaaactcaaatgtttacaaaataaaaataatactgtctaccagcagaagtgcaatgaccatattttttaaactatgatttctcctatatgtctatatttcatggctgaaattgtagttcagagctctcaccatcgtttctactacatacaaatcacttatgtcagtggaaatgttttctgccaagaagtgccaaattgtgagcctctcaggcctccagaccatgtttccttcacttctaaacgccattatgtcacccactgcatagttatctagtgcatataggataaacgctcaacgaagaaagccaggtcatgctttacaccttacattttgttttagacatattccttttcaaaaatatatccctgtgtaattaacccttctgtctttaaagcaaaggagttaagcactcaaatggcaatcaccaggaatgaggcccactacagtctaggagcaccagggcagtgcagtacaaaaaactcaagtagagaaaccagtgataactggggaaagttactttgactcacagaactttagttatcacatctataaaatgagataatacactctgccttattgaggcatttttttttattaaaaacagcctttgctttgtaccaggaaaaattaaaagcacttaataagcattaatttatgtagtcctcctaacagcccttatgaggctgtaaaggaacaaacaaacgtttctctctacttacactaaacatgccacactttttgaccagatgtgtgggttttgatttctgacacatccattttcaggtacatagttatgattccatttaattccgatgctgtctacctggagttacagtcagaacccacatgttaagagctcggtcccacgtgaatgccccctacttcagatgccagtcctaaatcgggctccccagaacttctggccaattgatataaattagagattcccatgaccgcctccttgggttcagccatttgctagagtggctcacagaacccaggaaagtgctttacttatatttactggtttataataaaggatattataaagaatacagatgaacagccagatggaagaaatgcataggaaaaggtatgtgcgaaggagcacagatcttccatccccaagcacctccacatgttgggcaacatggaagctctccagttgcagtcctttttggtttttatggcgacttcactatagaggcatgattgattaaaccattggccagtggtggttgagtcaaccttcagcccctcttccctcctgaggctatttaggagtcttgggccaccagtcattacccttctaaaagacttatcactttggagattccagggattttaggagttctgtgtcaagaaatgaagaagaaagaaatgaagaccaaatatatatttcttattctaaagcacaatatcacagaggaaaagagggtcagtatcttaattttataagggaggcatttataagacacagagaatctaagtaatttgtggaaggtcactcagctagaaagtgaagagctgggttttgaaaacccagattctggactcaatcattactctatgctgtatttcttcttagagtatatgaaattatccctgtgaaaatagttagactctggcattctatagctgttttctgtgacctgtgctctatattgtttttctttgcttcacagaaacgtaggtactgttttcccctaagttgttaattaatactcagataaggggcaagcacctctaggaaaaatcaaattataaatgtccagtacacttttatatcacatcacataatgtgacacattaaacagttgtggaatgtcaaaaattggcataatagatgacttgggaatgtagagtgacaagttttcatacaattgtgcctttttttgtgataatggtaaactctggaaaatttcattttctggttctgcagattgccagcacattgacatttcctgtatggtttcccaatgggaaggacagaattgtatttagccaaatctgataattttccttagttgaaattgaaggggctaaaatgcctacctacacttggatatgggcttcaattttttttgaagatacttattttccttctttgtttctaggatatagaggcagttcaggtagtttttcaggatactgcattgtagaagtaggcccttagtgaatcaagccattcatatacaagttgagtaagtgctcagagtaggtgtctatattaaggacagggtcctgtacattgtggggtgcttagcagttttgccatcatctgcccatgagatgacagtaacaaaccccatcttccctatgattatgacaaccaaaaatgtcttcagactttgccaacaaattacctttagatgtaatcactgatttagagcaatagaatttttggctctgtagggtaaatgaagtgcacctgatagcaataaatgacgcataccctgagaatgaccctgtatggcagatgcacctgaatgtgtgttccaagctaaggaactcgggaatggccaacagggagattcattccttgtctatgaggaacatctgaacctccagcctgtctattggaactcaggccacacaggggctcaagaccccgagttttgggttgaatgaaggttgccaggtggagactgtttgggaaagggtgctgagtgaaaatgctatataaactgcatgccctttgcaaatgattgtagttttcctgcccagtcccctgccgctgggctgcggagttatcttgtctagcccactgctactgggctgtttgtaaggcgattctcctgtccagcccaacaccactggcctttctccgtggtaagtaaagctccagtaaaatcccatgtcttgtttgctggccctgggtctctttttcagtctcttgaacctggtgccatcccctttagagtcgataggggttcagcgtgacaggctctttgttgtaaatatttgagattgatgatatctttgcacatattggaaaactttagatttcaggatagtaacttatgggccacaatgccaactacagctccggtaatgttacagtatgatggtttttaatgtgttccctggactagcattatcttttacaaataaaatcaaatcacatcactggctgaatgtttgagatgtattctcttctcattttaaggtttacgtaagtaatctctccaaataagtataatattaatagctgacagataaagagtcttttatatttacaggatgctttcaacttagtcttttctttaatttccccagtaactctgagaagagtttttattcacccatttgattagaaacagagacttaagaagagtaacttctgtctattctgagttagggagatcagaaaataccactgttctgagtagtattaggtgagaagagttttcttgctgattaaaatcctcaagtaaagctcttacatataagacttttatatataagaacaaaaaaccaaacaccgcatattgtcactcataggtgggaattgaacaatgagaacacatggacacaggaagggtaacatcacactctggggactgttgtggggtggggggagtggggaggggggagggatagctttaggagatatacctaatgctaaatgaggacttgatgggtgcagcacaccagcatggcacatgtatacatatgtaactaacctgcacattgtgcacatgtaccctaaaacttaaagtataataataaaataaaattaaaaaaaaataagactttttcctatcctcgagagcagtgtcaaaggctcatgactgtttttctcctgatctccaaattctaaaccatgtgctgcagtttcctatgttgatgtcactggttgttcaccctgggatgtcctatagactggagcatctgtctctatcctctccaatgagctgtcctaattatgttacatcaagacaacttgtgaagctcagaatctcaagtttctggccttacaactgatgagcagcataagccattcccactgctgttctcaatcccctccctgtcttagattcatagatccctaggctcttaagtgtcttccagaactgtttatcttgtagtcaagacccagaaattagacttccagaaacatagctcttcaaggcaggttcttcaaggtgatgatgcctgtgtcaccttgataggaaacctcctacactgtgtaatactgtcatctcagggagagccactgttcattagcttaaattgtcagctttatggttcagtgaaataaatacacattttccctaaggtaatgacttttttctcacttcgtgagagctgtagggacccttgttatcaagagataatcatattctagtggtgctacttattgtacccaatgaaagtcccaaggatgtgattatctcttaataactctaaagcctgttatgtatcatcttgtattttgtttactttgagtgtgtggtggggaacccattagtgatctctgtggttgatagtattcgttgtgaaatgataaaagaatcaaatgaccatttgtttgcttggagctagacagcacgattagaaatgcatcccaattctgactgaaaaatgcatttaaatgtaatctgttgcttagtattagtttaataaccctgatgttaatactaaattatatcaagcaaagctaatggaaattctgaaaataaacatggataatttagtatctacatgacctttacctcccacagaaaattcaggttgggttttaactacctgtgaaggaagtagatacccatgagaaataacctgctgattctgtgatggaaaatgccatcaataagttaagcaaaacaggagaaatataaggaaaagcctgttaaatacaatggcctttaagaatacggacagttgttaaatggtaactcttacctctcactttaggctatcctttgatattcaaataatgttaataataacaagtatcattaattgaatacctgctatagactggtttggcttgtctcattttatctattattgttattgagatggagtctcgctctgtcacccagggtggagtacagtggcaggatcttggctcattgcaacctctgcctcccaggttcaagcgattctcctgcctcagcctcccaagtagctgggattgcaggtgtgcgctaccacatctagctaattttttgtatttttagtagagatggggtttcatcatgttggccaggctggtcttgaacttcttacctcaagtgatctgcccccttcggccttccaaattgctgggattacagataggagccacggcacctggcccattttatcttttgaagaacctttcaaggtagataattttggccctgtcttacagatgataacaacaaactacaagaggttatataacttggttgagttcatgcagcaaataacgtggtaaagcttagactcaaatatgactttagaacctatattttgtccactgattatttaaaggcataatgtacagagtgactaagcgcaattataggagacttgtaatcaatggtgatcacatacacatttgttgttagacaaatccaggtctgactctaacaggcaaagtaaagagaccactctttggtccctcctaatgttatatgctatgtctgtgagaattgaaagctttagagatgccgcatctgggtttttgaacatgttcgttagaattattttcatgctcttacctgtcacttgggaagggttgtttttgttcttaataaataaccgacacaccttttggttttgaggtatttggaaagggtctagatcaggactgtttgttccctagggtaaaatcatcctttttgacctagaccttgccagctgctgcatctaactatttgctattagctgagaagctctgcagtcattcatggatttctggttcctttgttgtaaaattgcgagtacatttatgttgacagcagctgatttgttcaaagattggacccaatctttctgggcagagggagagtcgtctatttattcacctggttgtgtattaatttcctgcctattttcacatgtgattttatttagtttataataaaaactttaacttaggatagcgggtacaagttatggattgaacatggaaagtttagtgaatttttcatgattaaaaaaatgattataatgatagcatttattttctgcatagtatgaactgggcagtgttctcatggattacctcagtctagcctcaaaacaacagctaaaggtaggagtacattaggctcattttattcgaaaggaagctgagcttaaagaaggtgggtaaaatgaaaggtcttgccttgtgttcgcctctagggagagactattagccaatcaagtgcaatagattcagtttctttccccctgtaaagcagcacaaaagcggcccagaaaaaaattctgtgggttttttttttttttttttaaccttctttcaaggtatgaaattgggtatctacctacttgaatcatctctgttcatgctggctaacctaagatgggaagttttaactatgtctactttttcccctaacaagaatacagcaactgaacattttcccagtgaggtgtgaataaataattcctgcttatataatcagcaacttctcaacatcaactgaggtatcattagatattttcttttaagatcagttatgaaaatccactgtggaagtggaacttattttggcgtaacccttagtttataataactaagactatacgttggatccattcaatcattgagcatacatttaaggagcacctgttttagaccaggttgtactagactgtacaccttcagactgaagaataagacaacacaggtacatactttcccacagtaaaaggtatgtgtgttttggggtaagccgaacagtgataaatattttgtgatgagtggtatgctaaagacatgtgctgagtgtaactggagcacaagatccattacggtcctgagaggttatggttttgttaaaaggattatttcaaaagtaatattctcttactgttttagatacattttgatgatgtttgttgtttatttgggggggggaggtggcagagtagagtagtaattttattttgacagcaaatcccaggaggtcaggaatcttggtctgtttcttttctcctagtaaatactttttgaataaaaaaaattaatgtcaatgtaaaagctattggtctatgatagtaaaggaacagttgattatgattcatattcatgagccaggaatttttatatatggaatttccttacaaatttgtaggttgttagcattgtgacttatttgtattcattgctcacttatttgtctgcctcatttctacaggcacaaagccaggactttgtattactcacagaaaacttagcttcagtgggcttatgatttcttaactagtaaccatttagttgtaatatacagaaacttaaactagctcacataataagggttgttgaaaccatatgccaggcaaaatgatagtcttctaagcataaaaaaattatagctaaaacctaacctcatggggacttgacttaggaagtcaggaaatgtggctgcccctcaccttttaccctattttcagttcttcatttctcatgtggatcaggagtaaggatgtatgtaatcctaactctggttttctctaaagtcttatttttctggttctctcaagactggcttctttaacaataattccaactttacatgcctcaaactctcaagtgttgcaattcaaaatctctgagagagaatcttgttgacttaatgtgggtcaagtattaattgatggttcaatagctgtagcctattaggttgaatcacgtagaacatagggctggtcttttcaggagcaacaggtgggatgcattctttacaaaggagatattgtttcagaggccttcttggggtcagtcccatatattccccctcactcttcttacctttccatcctgctttctattctctttggcattgctctttgctccgtggtagctaactgacctgataaatgcattcatgatatgttagttcacccaacagataagttcttttggccaggattccctctggatgcaattacaaaaatcaaaggagtgaatttaataatgttttctataatgggcaagtatttgggaacatatgttttcttgtggtgctgatactgctttttgtgtgtacagtcaccatgcatgaaactatccataatgtatgagaatctcttgccaatgttactgctactagtggatactataactagtggctaaactgaatagctagtctgcattatgtaatttaattattaatttgaggattgaaataatcctttgaggatgaatactgttattgtccccactttaaaaatagaattgaggattatatcaattaaagaattgttcaagatcacatgattagtaataaattgaaccaatatcccatcccaagaaatttatcccggagcttatgttctcaaacaagaacaacataattattttaatgaataaaattaagttttcatttcaagtattattccactggatagggtaaatgtaatctctaccttctttctgtgaagaagaaaaaatatatatgacaaatttttagtaatatttgaaaaaacaaaaaactttgaccgatgtctgtaggattattataattttaattgttattgataggtaggctggagttgcaaatggtgccaatagctgtaaatagagctttagttttacatcagttgctgtccttaatgtaagaaagataggtgtttagatacatactaaacttttgtagctgactaatgtatatacagctggtaactgaccatattaaaaccaaacagatggtgatgtatttgtgattcagaattaatgtgaatatataatttttcataatccataggaaacattttcttacacatgtcatcatttatgaaattgtatttgttttaggggtatatgagaaaggtcagggattattttacatttctgaatatattagcaatatgaagaatacctgtttagtctctaccttctggttgttatcgatattatcctgagagtaaaggtagttaggtatttaatatagagatgaattattttgcaattcagccagagaaggcatacacttaagaaaagatcatgtttttatggctaatcaagaaactataacatttttatccaatcaattatgttatatttaagaataagccagagtagaatagtatgattaaagatatttctgattagctaatctatattatatatatctacataaaattttattttcagttattaaaactataagacagttattttacaaagaagtgatctatagcagaaacttggttagaggatacacatatgaataaacatgaaaacataaatatatacctttattctacgtaaaattaagtgtgtgtgtatttatatatatatttatagggaaaataaatttagttcttcagggaaaaatattgtgaggcaaaaattatttcacaattaaagtttaagtcggtagctttaagagaatgtacaatttatgtgaagagtgtttgtttttgttaggtaccctcattttatgtattcatatacctaacaaaaacgatgacgtctccatttattgctcaatttttattattttaaaatccttttaatgtaccctcttaagaaattgtctcttttattgaatctgaatgccataaaatattgcaggctcctagagccatcatactaacaagggaaagatagagtggtgatgaccttctcaaaagtcactcagctcatgggaggcaaggcggagaatggatcctggatcctaatctacacaattctattaagctggaaatctataccaaatgtatttaatttttactttgtcctaatccaatctgatttaattttagaccgggaagattacaggtaagcatcacctacccataagcctatctatgcttgaaaaaatgtatttatttgtgtattttttctttttattctaggaatcattgacatagagtaactccacagcatgtgtcttcaagagcttccctaaaaggtaagcttcccacaagggaagattttccttatgtgtagttcaccttgattagcatccttagtttctatggaaacattgaaaaccttcccttacagagtgatagcatgagattgtttttgatgtttttatgaatgttgaaattaatgaaagtagtgaagttacataaattaaagcctgaaactaagaaatagggactatttacatttctctctggagaagatacttaaggtaggttttctgtagtttagattaatttgataatccaaaaattttagaatttgtaatcatagaaagtgtatattgggaataaagttgttgtacttttgccaaatggtttcataggagaggatgttttagcagtcaaaccaacacaaatattaagttaacgcagtcctataaatactcagatcttaaaagttgaagcttttgaagggataaaacatgagaaatgtaactcactgtctacaatgtatgcaaattttttccttaataaaatatatagatgtaaaacagtaaaatggttatgttttactttcctgatgctgatccaataaagtaactggtggcttaaaacaatggaaacttattctctcacatttgtggaatctacaagtttgaaatgaaactctcagcaggaacatgctctctctttgaaggctcttaaggaggaatctctttgcttcctctagcttctggtggttgctggcaatgtttggtgttccttggcttcagatgcatcagtcaaatctctgcctctatcttcagttcacgtggctgtctcccctatgtgtgtccaaatattcttcttcttaggaagatagcagtcattgaattagggcccatgctaatctaatatgatcacatcttaacttgatttttatctgtaaagatcctttttaaaaagtcacattcacagattttggagattaggatttcaacagatcttttagggacatctaattcactcataacagtatgcctaaaaagagagtctagtgaaattaaagttaattattgttaacaatgtatttatgggaaaataatcataacatggagtggaggaaggtctcattccattggtatacataaaatgctgtttattttaatgatataataattatctcttgatggccagcttttctcccaagcaagataaaaattattcggtacagggtttgataacattgggtaaaatattagtatataattctgattctcagatttttaacaccctcagttaaaaaaaataataatcctggacatcagtgagaccctgtctctatgaaaaacaggaaaatttagccggatatggtggtgcatgcctgtagtcccactactgggaaagctgaagcgaaaggatcacttgggcctgggaggtcaaggctgcaacgagttgttattgcaccactgcactgtagcctgggtgacagagcaagaccttgtcataaattttatatatatatatatatatatatatagagagagagagagagagagagagagagagtcagaaatttatttcacttgattcttcaggtatttttcatgagctaaggttgagtaaggtgttttttaaccaactggctattgttctgtaacaaaccaccccaaaactcagtggctaaaaacagtaactttattatttcctatgagtctttgggatcagctgcttgggtcttctgatctggaacagactctgcagtattgactgggtatgctccttggtctgagcgcagctcacaggtcagtgcaagctgctccacaaggtccctctcctccagcaggaaccatctttcttaaggcagcaacattattccaagatactctgagtgtcctcaagcttgtttagatgtgctgtgttttcccttgcttttacttactctgttccttctccttggaatattctttctttccatctttttattccacttgaaaatgtatttcctttatgaatactgctctggtttctttgatcctattcattcatatatctttgtgtagctgaagatactgaactcatatccctgttagggtgaggcttccctcttgtgccaacatcagtgtaaacaatatgatattcacattgtcttgtaattgctagcttaattatcttaccctcccactgtgaacttctgaagccagtgattgcatcttcttgttcttcatggtattccaagaacctagcagtgcatgcacagatgatgtcttccataactatccatggacagaatgaaagatttaatgacatcttccctattctaattcctctcttaaaatttaagttgttgaaactttccagaatttggactgaaaggcaggaggtaggtttcctctcattttgatgatgccccttggactctactcaaagagggcccaggcaccctgtggtgccaccctggcctttcttcctctaccacagattgtaaaagttgtagtctgtgggacagaatatccccaaaacagttaatttgatttacataatagctctttttaacatagtaatttcaaaaataaaaataaagtttaacttgttgccagcacttaaaaatttggagattttacataaaatgattttttaaattctcctaaaagaaatcataataactttctatcctggacaatgcatttccagatgacaaagagggcttagctgaacaatagcagccttccagtgccctctccagttcgtcacaccatgccatttgctatcttctagccccagtagacacttgagtttaatatccttagctacccaaagatacatggattgatacagtgtggaggcttagctttgcttctaaatgtctgaacaaagaagtgtcagtggttgaatgggccatttagatgttcttattatatatccatcaactaagtaaaaataattttggctttgttttcaaagctctgtacttgaattcctgcatgtaatatttgaacagataatctctctgacctcttttttttacacatctgtaaaatggagactgtgatattcttcataggcttgggtcatgttaggttactttattaatgctagacaatttagtctaaactgcactcatagggaaaatagaagaagacagttacattcttctttttctggattggtacaaaaattttcatcttttgttagggtacattagcaatatgaagtactgatacatgcaacaactgggataaaccttgaaaatattataaataaaacaagcctgacaccaaaggtcatatattatatgattccatgttgatatggtttggctgtgtccccacccaaatctcatcttgtagttcccataatccccacctgtcgtgggagggagccggtgggaggtaaatgaatcaagggggcagtgatcctcatgctgttcgtgtaacagtgagtgagttctcatgagatctgatagtattagaagggtctttcccctcacttcactctcactattcttcctgctgccatgtgaagaaggactttgttggcttctccttccaccatgattttaagtttcctgaggcctccccagtcatgctgaagtgtgagtcaattaaacctctttcctttataaattactcagtctcaggtatgtctattttagcagcatgagaatggactaatatacatgtataagaaatacctagaataggcaaaactatagagacagaaagtagattaatagtttccagaaactaaggagagatgcaagcgggcagtgactgactgctacgatttctttttggaggtgatgaaaatgttttggaattagagagtagtgatggctgtaaagccttgtgaatacactaaaaaccactaaattgtgcagtgagtggtgaattttatggtatgtgaattacatctcaataaagtaataaggaaatatatgttttaggaagacaaaatttcatcttcagctgaggcaggagaatagggtctggaggcagggtaaacctaagggcaatttgcactgacttcctacaactgaatcaaaaggaaaaccccacctccccacaaccaattaacaaagggattagaggctactccctttgtactgcattgccgatgaaaaatggaaagtacctctgattggttctctcctgcaaccagtcacactggtcacgggccaagtcttcatgtgtaactttgtaacttcacttcagcctctaatttgccccctcctgcaaccaatcagacgtttgcatagggtgtaactttgtaacttcacttcagtctcttattggtcactctctgcaaccagtgagactggtcgcgggtcactccttcatttacatagtgtaactaagtaaccagtgggaaacctctagagggtaaaccccagaaaattctgtaaccagtgctcttgagccacttgctcaagattgctctcactatgtggagtacactttcatttcaataaacctgtgctttcattacttcattcttttgttgctttgtgtgttttgtcctattctttgttcaaaatgccaagaacctggacaactcatagtcaagaccctccactggcaacatagctatggtgacattctcagtcttttttgcattgctgaaaaggaatacttgaggctgggttatttacaaggaaagaggtttacttggctcatggttcttccagctgtacaagaagcatggcaccagcatctgtgtgtggtgacagcctcaggaaacttacaattatgacagagggcaaaggggcagcaggcatgccacaaggtcagagagggagcaagagagaggcgaatctcttttaaaaacaaacagctcttgcatgaactaatacagcaggaatttactcattacccaaggaatggcaccaagtcattcatgaacagtcttccccccatggcccaaacacctcgcactaggccccacctcccatctaggggtcagatttcgacacgacatttggagtggacaaacatccaaactatatcagtgatataacaaaataagcagattgtcattcaaatccacacacactgccttcctgagagtcctgtctgacctgactgccaaggccaaaggccaggtcaaattttttttttttttttagatggcatctagctctgttgcccaggctggagtgcagtggtgtgatctcggctcactgcaacctctacctccttcctgggttcaagcagttctcctgccccagcctcgtgaatagctgggattacaggcgtctgccaccgcacccagctaatttttgtatttttagtagagatggggtttcactatgttggccaggctactctcaaactcctgacctcatgatccacccgcttcagcctcccaaagtgctgggattacaagcgtgagccacggtgcctggcccaggaaaaaaatttaaacatcaggattcatggtttcatactgagattctgaatgatggggtcagacaggaatgaatttctattctaaatattttactgactacctctctcatatttctcaaaatgtaaaataagggtactgattagctcttttgttagcttaggaaaaataaatatcatgaacctactgtggttccagttaggaaatagaccctccataactgatacttttataattagtattatttggttgtaaatattaggctatcacattagatttttggcagttcaactgttccagggttggcttttctcttcctggcatcttagccagaaagaaaagaatgcctagaatttctgttagcacttaatgaatttaatcagcccccgagggacttttgatgtcagggaaatagttgacagagaaacatgatttttattctttctgtgtttctcttggtagttgacagagctttccctggcagaggtaacattacctgtgctgagagaggagtattaacatgctgtaagtgagatgttagaactaagagaacacatccctgtggccttacattaaaatgttccatgcatatgcttctgaatacaatttaagctgctgccaataagaaaataagccattgcctgaaaatgtgtgattcaattgtctatcatttttatgatttttttttaccctttcagacacattttagagattcttttttaaaaagtttgtttttggaaattgaaatgaaaattatcatctggaaatataagggataattgtgttattctgtgaagtattttataagctgtaatgttaagcagaaatttttaatcttaagtatggaaaaatatgtatatgaattgctccatttgatccaagtgatgttttatgcttttccttatggttaatggaaaggattatgctatgttgaatggccggaatatcaggagcatgggtgtcatttgttctcccaacaactatttttgggaagctaagtacatgccagaacatgtattaggaccaggtgatatggtgccaaataatatatgtatatcttctggaattttgagtttgctgtctaatagggggactgataacatacaagtagaaaaaatacatattgtgctaagtactgtaaaggaaaggaagagaatattatgatcgagaagcagagcttatagttccgcaccacaactaatttattgtgtgaccctctgataggctactgatgatgagtgggcaccgagcttctataaatttgacgaattaatcctttgaccattatggcgtgatcctctttttattcctgatgatgcttgttgacaaaatattacttcatttaaattaaatttgcctgagatttcctttctaatttgttttcaacctttatgtttagtttaggtgtatctcctttcagcagcgtgtagttggattttttcagtgtgaattttccccccttcttttttactaagggaattgaatttttttgcacttattttgattcctgaaatatttttaacattctttccatcaccttactttgtgtcaggatttttgtttctaaatgcttttccaccttcttctaaattaactggttttcttaattccattaatttcttattatttcggacgtttcactgttttcatttttagtgtgctctgccaaattttaaccttagcaaagtcaaatttaatgttcccaaataaaacctaaaattctttaactcaaattgtatcactcaaagttccaagttattttctatgcatattattttagctcaactttttcttcctcttagtaattattattatatttaatacattcaggttttaacttacatagattttcttatatactgaccagtttatttcttatcattgcttccagcatcccacttccttttgctcaaaagttcctattaaatttttagtagcttcttttaatggtaaactctctaatttttttgtatcactaaatatttttcttttgctgttatttttgaataatgttaagctaggattggaattcttagttaatggtattttcccctcaataccatgaagatattgttgtattgttttctatcctttattactacagataatgaaatctgctgttagtcaaattgatatgcttatgtatgtgatctgtctttttctttcctgctcacttttaagatatttcttacatttggagttctgcagtttcacaatgataagtccaagtatgcatttttgttgagtttttctcttacgctattctgttttccaacctcaggacacacttttttccagttgtagaaaattctcatttattatttatgtgaatattggtatttctaaaattacttttgttgtctcttttctgcattcttaaacatatttggaccatttatttctcctatccataactcctagctagcctttcacttttttctttatgtcttcattttgcattataagaaaattcctctggagtccttcagtttttaaatttgttgttcatcagtgtctattctgctacttaacttttgtatcatcaggatggctagttcatgctgcattattagcaaacagccccaagtgtcatggattaaaacaagaaaagtttatttctctctcatgcaacattctcaatgaaagttaacaggggagctctgtcttggtggaggcaccatctgggaatgtgaaggcaaaataaagaaaacctgtggaatcataaactggctcagaaagcttcctcccggaattgacacacgtcatttttcctcatattccactagcaaaagaagccaatggatgactccaaaggctataaggaaatacaatcttttttttttttttttttggagacataatctcgctgtcgcccagtctggagtgcagtggcaccatctcggctgactgcaacctccacctcccgagttcaagtgattctcctgcctcagcctccctagtaactgggattacaggtgcccatcatcacacccagctaatttttgtatttctagtagagacagggtttcaccatgttggccaggctggtctcaaactcctgacttcaggtgatccacccacctcggcctcccaaagtgctggaattacaagcgtgagccaccatgcctggccaggaaatacaatcttaatatgcacctggaaacaaaggagaactgtagtatttatgaaaagcactgcacggctactccaaatgttcatttttttttttaatttcaatttcttgttttaatttttagaagctctttttggtttatcttttttttaagtcatgttttcttgctttatcatggattcagttcctttttatttgtaattcctttacatactcttaatttctcctcatgttcattaatcttttattatttttattgtttatactgtatgtttcttttactgtgccaactgaattttttcatggtagtttttatttccacatatagttcgtaattttatagtttgagcccaccttagtgaactacttcctttctttgggaatgttgtgaactctgtgttgtgacagcattccccaagagtggttctgcttttgcttttattgagtctttaggatataaaaggtcacatatcagtttttgttaacttcttgcattttataagtagagtaaattagatcatatacttaacgcttggcccagccgtgaggtttttatttcttataggggtcatattgagtccaaagacaacagaattcctcacttcttgttcaggccatttgcatcatttttctaccttcttttcatggatttagggaatctgtgttttatatagggactttagatatatctccctgtgcttggaagactatgtctcctgtccctccttagacatcaaaaccctggctcaccagccctcaggcctatagcgagaaccaccctgtccctgaaccaccaccacattaactgaaacttattgcagagtcttcagttcctctgttcctttatcagaccttcagcattccatttcctttccttaaacttgatagatttttttaaattgttttacttatattttattcattatttttctgtgcctttaggtggtcattgatctatattagctgggttcattatgttttcaaaactggaagtttctaacatcagcttcctagcctataaaaaattattcaagttgcattatccacaatgctcttttaaccctatgactcatatcttaatatgaactaatacgaagaaaaacaagaattaataccaggtctcttgtcttctttccattttgatattaatcaattgtgtcatgttagacaagtcattaaactttcttgggctcaagcttccccatctataaaatcagcagttgaaactatatgccttagataaatgcattctcttctccaagctaagcaagtttaaatctgatgagcttttaggaaagatacaactttgtcctcagtactataatatttgattctttaattatttccagctgaagtcttttaaaatttacattattgcaataaatgttttacccgaactggtttggtaaatattttatatgcatctgtatataaagaaccatcatatcttattatacctagaaatgaatgcaattatgtttgccattttaagggtctcaagagttaatattaacaaagtgcttgttgacgtattttttttttcacatgaccttctgaagccagcctgcactactgccttttacataagtaaattagggtacatttttaaccttttcatgtttaaactaagacacatagtagctcttcaaaattgcaaaacagtctttagaacatttagtacacaataacccttctaattgcacgtgaaatgaaggactgtaaacttcataagtcacccagaagaacacaatgtaattccctttagagtatcctctttaaaagtggtctcagaatcagactccatgatttcagcaacacagtcaaagatgtactaacagatattacctaggttgccaatgaattgctgtcagttcatgttttatccatgaaaattttaaggaaaatgtaaaaatgatacatttgtttgaacttgtagagaaaattatgaaaaatccaagcttgtagggaatgatggactatctgcagaatattagcatagctctgattttgcaaacacgtggactcagataatcttacccagtggagacataccaatgcaaagtgaactaagatcttggagtactaatggacctatataacacattgagaatgttgaaacaacccgaaacaagctagagaaattggagaagcttaaacctgaggattggtgccctgaaatggaagagaaacaacagtcaactttatatgaacaggatgaaatagcatacaacaggatgatattaacatatctctgagcctgtgagggacagggaacagacttagagcaatccacccttgccgttaagatctattttgaagtgagacaggcgcttgtctcaaaggtcagggactaaatgtgtcttagagaagtcatcgtggttgttttaccttttcatccacctttgaaataaaagattagagataagatgaaatctaactagatccttgctaggagaatgaagttttaaaaggagagccatagtcacagctgtcttcagagtaggtagatgccaagtcttagggaagtacaggattaaccatgttggtaatgacagaacctaaggtatccccagcagtgttctttaagagtgtaaaaaacaaggattaggagagcaggtgattggacgcagctgctgaataatcttcttaacctcatctttactccacagggagaaaaataacaggaaaataaaagcttccaccaagtggttggtggcagtgaaacaaaaggagcatcaaaaagtacacaaggacagatttgtcctgatgctaataattctgaacaaaagggccaggaaattgctgtaaagtgctctgtactagtgtaagataaatacataattagtatacttaaataaagaaaaaaatagagtagaattctaggagtggttcttttttctaggcacttctaaagctgttattcactgagggcctaaataccttgtaatgtctcttcattaagtttttgttcatgaagtagcgagaaatgaatagctctcagtcaatatttaattgatgcttatacattgaatttaatcaggaactatctaaatgactcactaaccaacgaaaatttaagcaaggcaaatgtaacaaaggaaaatggggagcaaagcaggcaaatggtaccagattatgcatgagtaagaaatatgcatgagagaaaactttcatgtttgaagccatttgctacattcctggattactctagcacagcctaaataattctgattaatgcagcctcccaacgcatgatatagtctgcaatgaaaatggcccaaaatatataccttaatttctgtacaatgtactggttccttgttttagtgattctgtatttgtaaaagttcctatattgagtttgcttcaaccgtattgactgctgaagctcaagttctgtttatagcaaaggtcagggtctaaatatgtcttagagaagtcatagttatagttctccataattggagaactatatcgtacaacttctgccatgaatgtgagaccatctaatagtcaaactagaaagagtgaactcatagaacaccataagtaaaatgtaccccagataacatccagaccaaatctcattttatagtgcaggaaacttaggcgcagaaatgtttggttaaaagtggcacagattcacacaaaaccaaagtcttgatgttcagcatgcagaaggagagaacgtagttttccacaatttttttttcttcctcaaagatgggacaagggtgaccttactcgcattaaagaagtggatgatacttagttgtatttgaaagaaaaagagaacagagttctcatgctttgaaaacagaaagtaaatatgtatgatctcacttatccccctttatctgaggtagatacattccccgtggagtaggacagagcgtgatttcttcacgctactcggaatggtgtagaatttaaaacttatgaattctttatttctggaatttcccatttaatatttttggaatgtggttgactgcatcaacaaactccagaaagcaaaccatagataagaggggactactgtttatgaaatctaaaaaaactgaactcacagaagtagtaaaatgatggttactgaggttgggggttgagagggggagggaatgggggattgttggtcaaaaggtacaaagtttcatgtatagacaagaggaataggttttgagatctactgcatagcaaggtgactataatcaataataatgtatatttacctaagagtaaatttcaaatgtctcaccacaaaatagaggtgaggtgatagatatgttaattagctcagtttaatcatttttgatttttacatatatcaaaacatcacattttactcataagtgtatacaattatgatttatcaattcatactaataaaaacaaacaggtctggtgcggttgctcatgcctgtaatcccagcactttgggaggcccaggtgggtggatcatgaggtcaggagattgagaccatcctggctaacaccgtgaaacgccgttgagaggtgacaatgtgctagcagccctcgctcactgtgggcacctcctcaggccaaggcgtccactctggccgcacttgaggaacacttcagcctgccgctgcactgtgggagcccctctctgggctggccgaggccggaaccggctccctctgcttgtggggaggtgtggagggaaaggctcgggtgggaaccagggctgcgcagcgctcgcaggccagctggagttccgggtaggtgcaggctccacgggccccacactcagagtggcaggccggcacagccagcccctggcagcgagaggcttagcacctgggccaacgggcggaggggatgccaggttccccagcagtgccagcccgccagtgctgtgctcaaattctcaccgggcctctgctgcctccccttggtgcagggctcaggacctgcagcccgccaagcccgagctcccccacggtgggctccggcatggctggagcctctccgacaggtgccaccccctgctctgtggcacccagtcccatcaaccgcccaagggctgaggagtgcaggtgcacggtgcgggactggtgggcagcaggggatctactaggcgaagccagctgggctgctgagtttttgatggggacttggagaacttttatgtctagctggaggattgtatatgcaccagtcagcactctgtgtctagctgaaggtttgtaaatgcaccaatcagtgctctgtgtctagctaatctagtggagacttggagaacttttgtgtctagctaaaggattgtgaatgcaccaatcagcactctgtctagctcaaggtttgtaaacgtgccaatcagtgctctgtgtctagctaatctatggggactgggagaacttttatgtctagccggaggattgtatatgtaccaatcagcactgtgtctagctcgggttttgtggatgcaccaatcagcactgtgtatctaggatatctggtggggactgggagaacttttatgtctagctagaggactgtaaatgcaccaatcagcactctgtgtctagctcagggattgtaaacacaccaatcagcaccctatcaaaacagaccaatcaactctctataaaatggaccaatcatcaggatgtgggtggggtcagataagggaataaaagcaggctgcccgatccctgcagtggcaaccgggtctggtccccttccacattgtggaagctttgttcttttgctctttgcaataaatcttgccgctgctcactctttgggtctgcactgcccttaagagctatgtccttaagagctgtaacagtcaccgggaaggtctgcagtttcactcctgaggccagcgagaccacgaacccaccgggaggaatgagcaactctggacgggaggaatgaacaactccggacacaccatcttttaagaactgtaacactcaccgtgagggtctgcagcttcattcttgaagtcagcgagaccaagaacccaccaattctggacacaccgtctctactaaaaacacaaaaacaaaattagccgggtgtggtggcgggcgcctgtggtcccagctactcgggaggctgaggcaggagaatggcgggaacccgggaggcggagcttgcagtgagccaagatggcgccaccgcactccagcctgggcgacagagcgagactccgtctcaaaaaaaacaaaaacaaaacaaacaaacaaaaaaaacataaaggagtcctcacttgatgacaatgatgacagcttatatatttagagcacatatgaaatactaggtactttcctaatccttataaacacattttcttatgacgtaacctaaagtaggttccaacatctcataacatctcttcatcttgttgattaaaaacacgtaagttcagagtggttacataagcttcccaatatctcagtgtaaatctgtagcagagatgggattcccattcagttctatcttgactccagggtcagaattcataatcacttccatattgctacagttgaataagaactgtattttgggctgggcatggtggctcatgcctgtaatcccagcactttgggaggccgaggcaggcggatcacctgaggtcaggagttcaataccaggctggccaatgtggcgaaaccccatctctactaaaagtggaaaaattagccaggtgtggtggcaggtgcctgtaatcccagctactcaggaggctgaggcaggagaatcacttgaacccgggaggcggaggttaccgtgagcccagatcgcaccactgcactgcagcctgggtggcaagagcgagactccatcagaaaagaaaaacctgaatattttgaaccttaagtgaaaggagttacataagtaggcttcaagaaatgcacccaccagagtgataccagagcaactatttgcagtgaagtactaatagggactttgtgtatgagagtctgatattagcagcaggcagttgtgctgtagtgctttcagctggtattgcagaaaaaaaaaatcacacttggctgtaagtaagctgttgattgcttacacgggtttctgtggcatgccagctctccctgccacctactcttccttatcaaacagccaggagttctaagtgaggtgagaatcccacttgacaagcaggcataaaccatttgaggaaaatacaaattaaaaggctccaagacagaaataggagcattagcagcaggaagtgtcttggggatacattgtgtcagattacatccaggagttgggagaataagtgagtcatagcctcccagtggataagccctgttgtgtcagtagctgggcagcctcagaagctgtattagctatttaaagttgccagaactgctgtgaatgcccccaagctagcatctgcttagtaacatccttgaattatgcgcagtatgcctatttctcaagtagcttcagcatttctcctaacttctgacctgtgtcaaagcatagtgatagaattttgttcgtgtttaaggacagtaatacagaatagtaaagaactagagatattttgctcaagatcacctagcgagtcaatcaatgagctaaaattacaatgttgatctcaaggaacttttggtctgtgtaaaaatatggagcataaatataatgtcattgcacacatttgatcaatgtcttggccaagaaatctcagttgtcagaaacagaaaccctcttaatttagtccaaacaagaatttagtttacctgaaggatacagggaatctcatagaacttacagctacgaagtacagctttgttcaggtcaggagcaaaggttacctttctgtatttctgggacctatttcagggaccctgtggcacttagcattctctcttcttccccaatcccctcctgcgccctcctccaacccctgaaggtattttctttcatctttgcagtttcttctttctaccttagtatgtattcagtcgatactggccatcctagctctagactaacatgacccactggattgggtctctgtatcctaaccagagattccacagtgagaaaaatctcctgctccaaacagtttttagtacaaggaaaaaccaggacctcctaagataaagagttgcattcttggcagagaacccaaagatttttaaaatacattcagaaaattgccatcaatgctcaattgtaatctaattcaaattgtagcaggggcagggtttatccctggttagtatataacaacaccgggaagccacttccttcctgccttccagacctcccctcagttgttgcctgggtgctttttaccttgattggctcagtgtttcctgactgctaatcttgtatcaaagagaatccaatacaggtattggtgtttccacttcctgttgcttacgtcatttctagctattggtggggagaacagttgttactggaaaggggtcccaatcaagaccctaagagagagttcttggatctcacataagaatgaattcgagaagagtccataaagtgaaagcaattttattaagaaagtaaaggaataagagaatggctactccataggcagagcagtggcatgtgtagctgggttcccatttttatggttatttcttgattatattttaaacaaggggtggattattcatgagttttccagtaaagggatgggcaattcctggaactgagagttcctcccctttttagaccgtatagggtaacttcctgatgccatggcatctgtaaactgtcatggcgctggtgggagtgtcttttagtatgttaatggtttataattagcgtataatgagcagtgaggacaaccagaggtcactctcttcactatcttggttttggtggatttcagccagcttctttacttcaacctgttttatcagcaaagtctttctgacctgtatcttatgccaacctcctatctcatcctgtgactaagaatgcccaacctcctgggaatgcagcccagtagatcttagccttattttacccagcccctattcaagatggagttgctcttgttcaaacacctctgacacagttgctgtcttttttcagctctggtcaggaacttattacaggcaaagtgctttacagcttaaaaaaggagggataagggaatagatgctgtctttggctttggccttctttggaatatctagcttcttaactaagaataaatttttataagagacatttagatactgttaaagactagcactagacatttttactagaaattccaggattgtcaacacaataagatttatgcagattagatggtatggtgttgtttattattacaacttgataactagaccagtacttctcaaacttaaaagcgcttacagaccacttaggaatcctgttacaaatgcagattctgccctaggaagcctgtatggtacctgagattttgcatttctaaccaagacctaggtgatcctgatgctggtgacccacaaaccgtacttaagtagcaatgacgttaagatactgttttcatatccagaatcactgtacttttcagaatagaaattaatagtctaccttcttatttcagacctgaacaaaatgaacttcagtttaggtgggttacttgcttaaggacaatatagtttgtaacagtgttggaattaaaagctagattctggtgattctgttataccaacttaagggactaatatttattatgtcgattccatgctgttttgttcactttactgaaaatcactgcatacgtagccttaattcactatcgctgtctagttttcagctctagtaggtattgtaaacataaacatacacagaaacagatttatctattttccagccaagcttttgcaaagcaaaatccaggctgcagagagattgttgattgatactaaaattttgacagctgagagtatattttcagcaacaagatgagtaacttgggctaaaggagactgatgagaataaaacttagatttattaaggacctttccagtgagcagtctgtgtcatttctcaatgcaaaaataagtagtgtccaattccaattatatgatcctgcaacacgtaatttagctttgattaattgctataaattgctatcatcttcttaatcctgtatgtatttggtatcaggctttaatgcctgtaaatttaaatactggggtactcaatgaatttccaaaataatactctacagaatacatcctatttcatttagaagtttttaaaataactccagctactgtcttttatgtaatatgtgaattctacacttatcgtttcgttttataaaccgtatgtagcagcatcagtggattgggaacacctgtgtaccccatgtgacattttacttagtgtggacgaggggaagtcaactgcagcaaaatcatttcttttgatttctaacaatttcttctagccttatctgtaggatacttgacaaaaaaaggatacaatatttctatctatttaagatgtatatcacagtccacttaacagtttgaggaatgttttggtagtttctgtgaccttgagtaagctttccatttcgagcctccgtttttgcaactacaacatgcagacagtaacacctacctcgcaggataatatggatgaaatgacagcatatttaaaagcacttaaccagtgcttggcataggaagcactcagcaaatattcttttcttatttcctgaagcatttaatatatttaggattaagcgatagcaaaatgataattctctttacttacctctggcatctagaatgctcttggtgactggaataagttttaattgtaatcaaaactgaacgattaatagtgtaaacttgctgagggagaaataaggaggacatgctttccagaaccaattaaaaatgattttagatgatctgctatttcatattccccacaccattgcttttcctattagcaggtataagtgagaattaatggcaaataatggcaacacaaatcagtactaaagtgcatagtcatttttcatcatgcagctaaaacggtattattaatgtcaatttattggttatatataatgaactactatgctggagttttgtagaaattattttttattccaatatagttacttgatcaaggagactaagttccttttataaaataccagaggatgtcatgaatgaagaaatatggctagtccggtgcaggctgtgtatgcaggagaatgaggttttctctctcacaattacgtgagcctctgcagagtgtactttttcctggcctccagttgtggttaggtgctactggtagatttataaatatgtcatagttatatcaaatattttaatcattctgagccttttcgcctcatccaagtaaaacaattgtcttctccaaatgaagtattgtaaatatttatttgcagattttaatcaacctgtgacagccctctcatatgataaaatggtaactttgtaagattcgatgccccaaagatacatctgcaccatttaattagctggatgtgagtctacagtagagtcaacttagtttttacagatgggcttattttctgattggagagaaccgcatacagctatgtaattattacaacgtataatgtacaacatacattatatatatagtgtataatactccagtgttcacttaggagttcctatctggaattggtcttgtatctgttataaacaattgtagtttctgatagaagttacataaacatggagggatttttattggtatgatttcaaacaaatcattttctaccttaagactgagtcaaatccaaactagcatgtgcttaactgaaatcatgtatatatgattttgttttgttttgtttttgagacagaatctcgctctgtcgcccaggctggagtgcagtggcaggatctaggctcactgcaagccccgcctcccgaattcacgccattctcctgactcagcctccagagtagttgggactacaggcgcccaccaccacgccctgctaattttttgtatttttagtagagacagggtttcatcgtcttagccaggaaggtctctatctcctgacctcgtgatccacccgcctcggcctcccaaagtgctgggattagggtcgagagccacggcacctggccgtatatatgattgtttattcactaattccttcacttgctgaacagatattttggagtttctaccaaattctaagtattgtgcagtatactgttaagcacaaccttgtttcaaaggaagtagtagtcaaagcagagtgaaaaccagatgaacagattattcgtcttaatctacagacttagaaggaaaaaactaccaggcattatctgccagatcttctcataagcactttcacatattttctgtcatatgaacagattatgactatttattgtgattagacctgtgttattttgaagcatgaagtaaatggaaaatgtcacaggagaggtgacattggaacaggatggtaaagagtaggagattgcaagagaaatctattctgtttgagaacttctaaacagaaggtcagtttgagcataaattaatgattaatttttattcccttatttttagcagtaaaaaaaaatattttactgttcagtttaaaaatgtttctggaatccttagggttttccttttgctccccccaccccttaaacaattctatttcatctttcagtgaactggaaatactgaaaaaatataattttgtccgtatttcagtcttctataatatgtttgcccaatgaaatatgaacacaatattgcataatactgaaaactggctgtattagtccattttcatgctgctataaagaacttcccgagactgggtaatttataaaggaaagaggcttaattaactcacagttcaacatggctggggaggcctcaggaaacttaaaatcatgcaggtaggctaaggggaagcaaggaaccttcttcacagggaagcaggaaggagaattcccaagtaaagggggaagagccccttataaaaccattagatctcgtgagaactctctcactatccggagaacagcatggggaaaaccacccccatgattcagctaccttcacctggtctctcccatgacacatggggattatggggattacaattcaagatgagatttaggtggggacacaaatccttaccatatcactgggatttaaaaaatttgtaaatgctcatcatttacctgtctgaaagagtggtgtggggttcaggatttcctctagcgtaatgagtcagaatactgattgttataaatgttcactgtggctcttttgtgggtattgcacaatgtattgttgcttttcttaagcagttcataaagtaagtaaggaagtgacttgtatcatggtcatgatataaattgtattagacaatacatgatgagatgctcaattcttaaaggaggagagattcttctttaatcttaatagcattttctctgtatctccttcctagaacataagttaacgtgtgtacctgtattaacctcacccaccttggtttgcaactcactgagcacaaggaatatttgtattaatacagttgttctaactcagtgcttttcaaccaggggcaattttgtccctcaggagatacttggtagtgtctggagacatttttagttgtcaacactggaggataggtgctattttgtaaccagtgggtagctgccaggtatcctgctaagcatcccacaatgcagaagatggcctgtacaagaaagaatcatctggccaaagatgtcaagtgtcaaggttgagaaaccctgctctgtactataccctggggtcattctgtgactttggcattgttagctcatacattcagcccacactaaaaaggagaaattgatcacctaatgtgtttatccaactgtattggaataagagctgagttattaggctggaaattacatgttctgctgctataaaaaaattttacttttataaaataaaaatattttctacctaaaaaagctgaagaaataacttctcttgtactattgtgtggccgtagcattagtgacttcattcagtgtgtagacattgagcagtgagcttattgataggccctgcgaatctgtgagggagcaggatagacacattgttctcattagctctctaattccacaggatctgagacagatgtgaaacaaataattacttaaatacatattaaaattttaatatagatacatgatttatggtcagcagaaacacagaaactatagaaagacctgagttggaggggtctaggaaaagttccatttaagtagaaaaaaggaggtgtaagagttgaccaggttgattaagcattccagggagtgggaccagcataggcatgaacttggtgcattcaaaaaactgtaaggaaccaagtatgactaagtgcagcagttaaggagagtggcttgagcatgaggcagggcccagatctatcaggggtccctatattccatgtaaaggatttctaactttattctaacaacaagagaaggagtttatcccagctctggcaagatggtggtggccgtggtgctggcagctgggttgtgccctctgcagagccatggcggccccagggctgcgcggcacacatctgaggagctgtaggtgtgactggtgggaatgaaatgaccaaggcccagcgggcaattcctgggggtgtagccccaaccatcttctgtgggatcctggaccatcgcctcccagcctacatcctatatgaggactagcagtgtcttgtgttccctgaggtggctccataggctcctgtgcactttctggtcattcctaagaagcccattcctcggattaaccaggctgaagaagaagacagcagcttcttggacacctactccttgtgtgtaagaagatagcaagggctgagggcctaggagatggataccaacttgagatcaatgatgagaagctgggtgaacaatccgtaaatgacctgcacattcacttacttgggagctgacagctccagtggcctccagctttaacctctgaactgaccaaggaccctagacctgggtgcttggatgggaaagagaaaaagggaagctgtgatgttaataaaactgctctctcccaaaaaacaatcaatcagtcaatacatacataaataatgaaaacaggggaagacttttagggagaacaactattataagattctcacataaagcctaaataaagcaattgaagaacattacagactgttttttttcctttttctttatattttcttatttttcatgtatctgctgagacaatgttccaggtttctacaggaggatcttatgatccattaattggattgaattattgtaggtatctatatctgaaccagtcaaagcctggctgattctcttatgtggtaaaatgtcaaagtatcttcatactgcacctctccattagtaagccatgtttttagcaccttgtggtaaaatatttttcagtgttactaaagaaaataaactagtatttttcaaatgtctcctatgtaatgggagggaagtaacattcattggttgtttaccaagtgctaggactaggctaagcctgtcacctctcttcttcctctaaagcaggtgttttgtttttcataaagattagaaaaccaggtctcagaagttctaaaatgccctagtaggttaagactacaattagtaattggtaaacatgctgttagaactaatctttctgactcccaagactgcaacttttctctctgcaacatggaggagctaggtcatttatatgtctcatttttaagctatataacaaccatgtgaggtagacattattattcacatattttatatgtgtagaatctctatctagggtgtctcagttagtaattcctgggagctgcagtttagatccagatttacctgactctggaaactcttttcttttcactgcactctgatactgtctacaaaaattaccaaagtctaacatctttcctccttttatagactttcacgaagatagagaataactggtcagcatcctcttcaaagtggctttctgtataatttaaagtaatcttcaaggtggtattgatagcaagcttcataaagcatggactgtagtaattctgccaaagactgaaacaataaatagtaaggtaacatataatctatagctttaatgtaggtgatttcctacaaatagaaaataaataatgcctattgcatatttccagttatatgatctcttcttaacaatcattggagaatagaatatttataacagactaggcaactttatgtttcacccatctgagagctagagctttgcctggatatagtgctataatatttcaatatgactccttaaccttgtctagttgggggcttggtttgggggtgggcaacgtggtatatttcaattaaattaactttggaaatcatacagtgctagatttgaactctactgctgaaaccagctggcagtacaactttaaccctctgattcgctgagacattttttattaaatggaaataatatttatctcagagttgttgtctcgatatttataaggtgcctagcagagtattagatagaaattcattaaattggaaagttccaacatagtcatcatcatagttgctgcccttgctgtttttattctattttgttgttaatctttctatttccaaggacccctaagggttggcacagcagggagaaaggggtcctactggaatctttggaagtgttgacaatagaatttcctttaaaaaacctctcaaatgttagctgaggttagatcatttcaaaagaaccttctggcatttgttgacaatagagccattctagatctcttttaatctagttgagtccccggagaacagttaaatagttatagtgcaggccttgcgcatgaagcaaataaagtcaatggatactttattgcactgagttgggaaattacaagtaaaaggaaaaaaattatatcaaatgtggcccaatgaatctagtttcctggtaattgaaagcacttgttagtgattccaacaaagttaagggaaaacattctattgttaaaaagagacacctctctatggtgaatctaggccattgccatgacaatatcaagtcttgtcatttctttattttactttttgttctctctgaaatatgctgttttcatagtccacaagataatattaataatagtgcgatttggctttgtattggagacatttttcaaagcatttatttatccgttggggataaggaagttacaatacaatacttgatatttcgtgtgtatttcacctggtaacttaagtacgtttctaaattttcaattttggaaactcctatggttgttctttggtttaattttttttttatgatgacagaaaagactgtaatgtgatttgaagcccttgtaacgagtacaggtaataatgtatccaggatctcttttcttctcctcaatgccaagttaccttacttggttcagcctgacagtttctttcatctgcactccctgcgtagttcctacgtttaacctgcctgaaacacagctcctcttggtccctcatgtgggcaaaagtcagccccattctctggagtaatgagtttgatcttgacattcagcatgcttcatgatttgtcctcaacttgactttctaatttctgaatgaacatgtttcccattactttccaggcccagtcaaattaatcttaatgatgttgaattacattgaacacaaatttatcttttcaaactctgttctacacagttaataataaaggaacaaggaattgggggaaatgcaaagagagaaaaagtgggagaaagagacaatagaatgtacatatatttctatcttacgttctgctggtgatgcttcttgccaaagtgaggctgagatgagatgtgagattcccttctccaagttgccatctgcctcttttgtgtgaatatcttgcaattctcagtgtgattcttgagtttaaataaaaaaatatatatataccatgttgtccctaaatacaggtcaaaagtcatccacatatagtgctgagtttaaaaacagtgacctatttcaatgctaggaaaaaacaaaacgtaaacacaaaacacagaagtctgtctatgttgggtttgatgaaaagagggtaaaatgttttatttttgttttcggttctgcctcaaatacggttttcctagtctacaaaattatattaacagtggagcaatttaactttgcattgtagacatttttcaaagcatttatttatcctttgggggtgaggaagttacaatacaatattttatccatacccaacatggcaactccataatgaatttgggtaattttattacatgatattttcagcttgttctttgaaccttagctctcaattatactactttctctactggcagcctatcaatgtttggaaagcctcttcatttcttggttatttcagtttccaaaaagtgaatttatacaggtagaaaaaagtacattttcacgttttaattaactgagaatccaggaaactaaattcatcaaataatgttgtcaatttcatataagtaaagtctttttataagtcatccacaaaattttaaacatcaggacctaaattctgggattctgattaaaaacttatgcccatttcattcatgataatacttttctaattacaattttcctctttgttaaaaaataaggctggacgcagtggctcacacctgtaatcccagcactttgggaggccgaggtgggcggatcatgaggtcaggagatcgagaccatcctggctaacatggtgaaaccctgtctccactaaaaatacaaaaaattagccaggcatggtggcgggcgcctgtagtcccagctactcgggaaactgaggcaggagaatcacttgaacccgggaggcggagcttgcagtgagccgagattgcaccactgcgctccagcctgggtgacaaagcgagactctgtctcaaaaaaaaaaaaataataatagtaataataataataaataaataaataaaagggagtggaaaaaaatctaccaaaccttggattcaaagtccatttctttcagagattttattgtaagcattatcttattgactatgttcacataacttttaagagctaaaagaataccacgtttaatatgttgcactctaacaattttaactaaaaatattcatgcttagttacagtgtgtagaaacccaaaatattaaggatatatgtactttgtgggatgatcctctgatttaatatatgtggtctcttgaatctccctatattgaaccttcattttctaatatttattgtgcagttctctctctgtggtgtgtgtatgtgtgtgtatgagtacagaaatggtatataataaaaagcagtttctagcataaacaacaaaatgaataaactacacaaaattacagaaaaaacactaatctacagaagaaaaaaatgctggacctctaaaagtgaactatttattattcttgagaaaagcttatcaaatgagacttgcaatatatataagttgcttttccagattttattttaaaaatacaaaggcaaattactagtgctgtatttgtaagattaaactgcccactccccaatcagatttttggattatttacatgaaacgaaaaacacaaaccacccttgaaaatacgaaaatcttaattatagttacggtgtacagtggataagtgaagttagaatatctttctactgatggaaaaatgtcacttggctttgagatgagtcttttttttatttttattttttgagacagagttttgctcttgttgcccaggctagagtgcaatggcacaatctcagctcactgcaacctcctcctcctggattcaaggtacataccaccacacccggctaatttttgtaattttagtagagacaggggtttcaccatgttgaccaggctggtctcgaactcctgacctcaggcaatccacctgcctgggcctcccaaagtgctgggattacaggcgtgagccattgcacctagcatctttttaacacagggagagaatccattgaaacttttttttctctgtaacccctaacaacgttcggactatttcagcctttaaccatttggccctactgagtgtcattagattggcctcaggatccgtaagtactattatttttctcttgagcttacctctacatttatttaagcatgaaccttctcagtggttcactatagctttacaattcagcactttatccaaatacagctagaaaacttctttttttttttttttttttttgaggtggagtgtcgctctgtcgcccaggctggagtgcagtggcgcgatctcggctcactgcaagctctgcctcctgggttcatgccattctcctgcctcagcctcccgagtagctgggactacagggcccgccaccacgcccagctaatttttttgtatttttaatagagacggggtttcaccatgttagccaggatggtctcgatctcctgacctcatgatccgcccgcctcggcctcccaaagtgctgggattacaggcgtgagccacagagcctggcctctttttttgttttaacctctcatttcgaggcttctgtttgatctgtgttttagttagtctgagtttatatgtggctgtgtctagccatttacgtaggtcaattggactcaaaacccatctttcacttgaacctgcctttctttacctatcctatgtgcaagttctcttgctatttattttgacaccccacaaatttatcgaggttaatagactactaattccaaagcatttctaaatcagattgagtctattctctcagatctgtgaatacctattagggatggtatttgagataaaaatatgaataaaccgtacccttcacattttcttaaataataaaaaaaaactgaacagaagtgcaagactataaaatctctgactgcattaggagatcattattgcagtgttcaagtgtatggttatgactacaaagcaagaaaataagttttcttctctggttaacttacagccacatctcaagcattataaagaagtgaagagggaaatgataacgtaaaattggatggtgaattaaactttcattgtgtgttgagctcatcctaagactaaagcacagaaacatgtccataaaaattgtgattgtttttttgagatggagtctcactctgttgcccaggttggagtgcagtggcaagatctcggctccctgcaacctccgcctcccaggttcaagtgattctcctgcctcagctcccgagtagctgggattacaggcacctgccaccatgcccggctatttttttctatttttagtagagacacagtttaaccatgttggccaggctggtctcgaactcctgacctcgtgatctgctcacctcaacctcccaaagtgctgggattacaggcgtgagccaccacacctggccccaaaattgtgatttttattggttataagacctaggcattgtccctgtttttgagttttggaaagctaacattttaaactcctgttcacaaaacaggtgagagtaggactttcccctctcactgtgctaatcatattactatcgttggtcttgtatcaatttttaaaacatcatagccattattattttgcagtctgtattatttcttctaagtattaaatgacagatattgatatgaagagcaagaggctctccaaggaagcctcatctgtacaaagattagcaagaggttgcagcaattatgaaagttgccagaaatcacaaatgttcctaattttagggagaataggatgccccccatcacacataatggctttatcatcaggatttgagcccatgcagcagaatatccaggttctcttagaaaccagatgcttccttcctcctgcttggaaattggaaatatatttacatcttcaagaatgcgcgaggttcttctctgaagcagagccctgcattgcatctaattgtagaaattacaaaacttgtcagaaagttaaaaaaaataaaagaaatagtaacagttgcattgatttagaaccagctgcctttcttttatccaccctgatagagtagtgctttaattatttctcctaactaaaatgatacttccctcttgagaatgtctgggcctgtttatactgtcaccatcgttttgatacacaattgtccatattgatactctgtttttaccattaattttccaaagagcctctgaactcattgatagtgccggaacacagccttgccaacacagtgcccagccctggtaaactgagtcccgacaccacttttagttccaaaatttggggaaaaaatattattttgctttcacattctctctgctctctttaatacacacaactgaattcacagcctgaggccagcagagagcttagttatccacatctaaaggccccatgtcacaaaatttatctctgatatttaatatctttgaaagcacttaatacaagcccagtgttagctattctgtagtatgcctgaatccattaaaatgaaaaaaacctcagtaatgatattatgttgaagagaaatgttttataactgtcatactttggttttcctgaaatcataaaatggtcatgaaaatgatttacaaaaaaactgggttagagtgtaccagagtaccatagtcaagtataatgacatccaaaagaatgaaatgagcatggatagaggagggagaggtgacagagtaatgaattgccccctactgattttgttcctgtttgatctgacaacattggaatgacagctgctgaatgagacaatttgattcaaatgatttgcatatttttcaccagaaaaagtggtttgtagtttatggaatgagtcccttattctaaatatggtgctaatttcaagtacaggtatcctctgatattttgtgtaagtgaatgtgttacttattgttaaccagtattgatgaatttttattatagatccaaaaaatgatataattttagagatttatcccaatttctatcaaccagaaggtgaatatataccagttttccaaattacatggtgcatccccccacctccctcttttggtggaagattaggcatgcagtttttaagacccaatcaatctattgatagtgttaagtttcactatcctccacctgaaaagcgtgatttaaaagcaccaaactaagtatagcaaagttcttgcattgcttggcaatttcataatttcaggtttatatcgagtgagaattacaatgtgaaggtctttacttgttttgggctataatttgagatggaagtgggagaatgtgtagaatggttgctgatcatatatcccagatgctgcatttgtgggagaatggattgatacccagaggttccttctaacatagttcatcaagccagccagaaatttaagttaaccttgatatcccctgaggttaggttcccactgcacttggagtaaagactagcattctttttgtggctcatacatgccactgtgccattcaactctttcttttgtagcacttattcaaggtacttactgcctttttaaagtttgctcatctgtcacctttcaatacaatttacctttaacaccctatttaaaattacaaaccccaaccccaatgctctggctaacttttgcccttcactttttccttttttcctctagcatttatccttgcatctgtctgtctcagcatcttggaatatgatctcaaagagcacccgattttgtccgtatcgttcaaagatgtaactcaaatgtttataatagtgctttgtacatagtaggttctcagtataacatttgttgaatgagtggttgtttttgtatttcttttattatttaatttttgttcctccgctagattcgtgttcaggattatatccccagtgcctttcacttatttttcatgtaacatatatttttgaatgaatgaatgaatcaagaaaaaggttctggaataattttaatatttacctgtctgttaaaatattctcactagacctgttagaaactcaaagctaaattgaagctgatgtgatttctattcactaatttcctctggcaggcagtgattgggaaacatggtaaataatcagcgcatgtagttgtgctgtttaaaatacagcagttggccaagttctgtaagtatacaaatatattttcagtagatgagttaaaaccagcatctgattactttgtgctgtttggcttaaatagaaacaatttcatctcatttaaataaacaatcatcatatttttcatataaatgatgatataagctctggtaataagggcttatgttattgcttagaataggaaagttgcataaatgtgatcactctcaaaataatcttttgttacatcctggggagggggtaatgacaagcacttgcagtagctctatttatttatttattcatttttattgaggacatatgcttcagaggcttaaaacttaaaagattgaagcagtattataaaggagacataaatggcttttaatgcttgctgaaagcagataaacttaaagacttatgaacatcgtggctaggaatatgtgatagaatgtagaatccaaagggcaataaaatataaatatgtttctaatttgtgtattcttccttgtttaccataggatgtgacacattcagtgctacaagctgactgtctatgtccatatgggaagtatacacattgttctaaaactataaatcagggacatagttgaaatttgacaccaggttccaatccctaatgtcctctgaaaaatgtgagtttataaaggaaagcaatgtttccaagtaaattcattgtcttttggggctggctagctggcttttagagcctgacaggaatgtttttatttcttcagctctagaaaaggaaaagaggaaggaggcagtagaaaaaccaattgagtgagagtcagaagatgtgggatctagtggtaggtgggctgtaataaattgtttgacttaggccaggtgtggtggctcacacctataatttcggcactttgggaggctgaggtgggcggatcactggaggccagtttgagaccagcctggccaacatggtgaaatcccatctctactaaaaatacaaaaattagccaggcatggtggcgtgcacctgtagtcccgttacttgggaggctgaggcacaagaatcacttgaacctgggaggctgaggttgcaatgagccaagatctcaccactgcaccccatcctgggcaacacagtaagactctgtctcaaaaatcataataaaataagataaatagattgacctgaaaagggctttgtttctaatccccctggggttcccaaaactttttaaggtagggaagaaaactggggttagaccaattaatctcaaagtttcatccagtaattacagattcagtgatgactgttgttctttagttaacctcagaaaatctgtgaggtaggccccacgtgggttaagcacagttgcactccttgggcaggaggaggtagtggctgtttaaagacctagagattaatgaaataattactctgcctgcacctcttttctcatccctaaaagggaggactgcttttctgtacttcccaggaatgccgtgaatcgagtacgtacaactgtgttgtttttgaacgctgaaagccaaggtaataattagaaagtgtggatgtcacacttattttataaacactctttaaatggatacatgagttagtgtttgcttgatgttgcgaagcaagctgcagtttttgtctactcttcaccccacctaagaatctagttttcagcattaggcaaatgcttctggtacaagcatgtattaaaatttaaaatctgttaatgggttttaagtaggatcttgatgtttggcagaagtatcaataacatcggcgcctaaaataaatattaagttgtaattttaaagcttctattgtcatatttggacagatagatactgtgcagatacagtatgtggaagcattttaaggaatttcagttctagaaaggctctttaaaggtcaacctaattaaagcaatgtttttgagccagtacaaagtagatgcaattattggaaattcattgcaacagcacggaatggcatttcacttacagtttaaactttttatggttaatttagaaagcaaaaatcatcttttttggggggttcctgatctctgacttaaatgacattttaatcaataataatgatttctttgttaggattaggagaacttttgttctccgggatacatggcaggaatatttagcagctctattttagaacccctaaagaagatggttcttttgtaatgcaagtgctgatctaactcagtaaaggaaatgggcttctcacgtagaaggtgatatgcatggacatttatttaccattgtctgtccatagattgtggaatgaattggcttgtgtggaaaatacagaatgacctatccctggatcccagacagagttttggatactacaggttgtctctgcaaggaaggttacccagctcccttaaaatcattctataggaagttcccctccatgcttcttcatgcagtttaactctaatacctaaaaagaagagttgttctttccccttgatgtcacatcctctgtgtatattaagagtttaacttaaaaatgttacccatttcattagattgcttgagtatgatctgtaactaccccgtatacttcacagactaggtcctcagaagtcctctgcattttcacataaactaaaaacctccagtggtggtgttcacttgtctatgtgtgaagtagggacatcatgcattcctgatggacctcactaatgtggcaaggcttgtttgaaaaaaagaagaaaaaaaggccatgcttctaatgagaaataattattggaagcaataaaatatttatattccattcattaaacacactgaccacgaggaaattaaaaagtattgaattccaaaactatcacaaatacagaaaatatacatgaatgtttaaattttcatttaatgatgaaatgaagatcacattcttcacccttagcaatgctaatcacgtgtcactggttgaaatagtgatcaaataaatgagaaaaagatgaatgactttcccaaaatgttagacctatatttagatataatttaccattttgtaccataacctattacttattttagcaaagtcccaatccactgattattgtcgcattgtgtcatactcttcaaaaaaatgaaaagtccatctgacaatatgatatcttagaaagtcattgtaaaaatctgcttcagtcaaaaaaggttttatgattgcatattaactttgaaattaatcaacaagttgacagtagacagtctctagtgtctctaaatatatggcatgtctttgccataaaatagaaattgctacctacagatattatctgaggcattattttgccttgcggagggtatctgttatgttagagaagtgatttctaaacaaactttggctttgccaaagtgtcatgctgtttgtattttctttggtatgtcacaagtcatcccaacatttccctctcatttctttctttttctttcttctttttctccctaaaactgaaggagatgggtcattttgaagatagaaaagatattacggtggccctattttctaagggactttcaatactccataatatgacagcctaagcttctctagcagaaaaggccgcctgggtgcatcagttaagttacagatcctactctgctttctctggcaatggaggaggcaggtgattgcctaaacacaaagctcctgccaatttctgaaaggcacagtggctggagcaaaaagcaactcatcttcccaggggcctgccctattctgaacatctctaaactaaaatgattcttcttttcttttttcttgatcagtcttcagtcactatttttatatcatgaagtgttaccgggtttatgtgcctgtccacatttcataaagttagaggacatatggtaaaaatctaagaataacatcataaatcatccatgcctctgaattgcttgaaaatgttaaatgccttggttttggtccagatgttcaacttgccccttttataccagcctgacatacatcagttgaaagaagaaaaaaaaaaagagaaaaccctctgctgttctctttcagcttaatggttgatatatttttctttcttctctgactttgccatttattgaagcatagacgggtgccctaccctacatgaaagctatttcctactgcttgtgaaagaaaaaaaatatgaaataaacacttactattctgttacaaggtaacaatagagtgctaattgctgagtaaagtcatgtagccccaggattatgttgagggactccactataaatttgaagacacccataatccatgtatcaggcagaaaatgatttgctgtgctgcacttctcctttaacagtttctatcgaactatttaattaaatggaataataattattattccctgatccaaattagaacactttcttgtttaacgttcctagtaagtgcacaataaatattaatgttaatggtgatgatgatggtgttgatgtgttttatggtaagaaccaagaattatgggagcacagaaggtggatgacttttcccttttgggcaggagcagtcaggaaagaattcacagaggcggtaatatttgaagtggtctttgaagtatcagtatttctatatcactaggtgattcttgagatgaagataagtgtttttgatgcattaagcacagtccacagttgcagttgtcactgtttttaggtctttctaccttgaggatttcccagttctcaattttcatgttctgtttgtttctgtataattttgtggagttgggcacttgtatgttaaaaaaaaaaaaaaaaaggtcaggttaacatataatatgctctgctatttccacttttgatatttgctttcttctctcatgttggttgtgtgctgaccatgcactgactcattatctgtcaatgctcagttcttatacagtgttaaggcaccagctgaattaacacaaaaagaaaatgacagagctcagcagggcgcggtggctcacgcctgtaatcccagcactttgggagactgaggcgggtggatcacgaagtcaaaagatcgagaccatcctggccaacatggtgaaactccgtctctactaaaaatacaaaaattagccaggcatagtggagcacacctgtagtcccagctacttgggaggctgaggcaggagaatcacttgaacccgggaggcagaggttgcagtgagccgagattgcgccactgcactgcagcctggcgatagagcgagattccatctcaaggaaaaaaaaaaaaaaaagaaaatgacagagctcttttcattccaagtttttagataccatatccagttgttgttgaacatgatggcattattagtgttttcagtagctcctctccctaataggaaggaagcaaatgggttgcattgaactctctttaatatgagtgctatcttcagcagtgcttcattatacaaagtattaatagaatgactggccatgcctgcaatcctcagtcattttctctagcttcctcacccacacacaggttgttaagtcaccaagagatgtgttacttctgtgctgtgccctgtgaaagctttcctctctagagatctggtatcttcacaggaaaggtcaaataggtttcattgtctttgcacagtatcacactaatttaagatttgagtttcttttaaaaaacacagctgtgagagagagagagctcctctgaagctgagacagtaaaactgaagatacccggaatatttataacatatgtttgcataaagcaagcttgtccaacctgtgacctgtggaccgcatgtggccaaggatagctttgaatgcagcccagtataaatttgtaaactttcttaaaacatgatttttttgtgattatttttttttaacctcatcagttattgttagtgttagtgtattttatgtgtggcgccagacaattcctcttcgtccagtgcgacccagggaagccaaaagattggacactcctggatgaggcatttttaaaaagcagataaaataccaatgtaaagatttatttttccaaaagagtggattaaaagaaagacaagtgctaacaactgttgttgtcacctcatggttttttcagttgtctgtatgagatggcatcgttactgactcttgcaatatttggaataatataaactaagtaccacagtgtagtttgaggcttgagttctataaatacccatttcattaatttggggaggagaaatagatgcgacaaatgggcccaacatacattggctcaacaaaatagaatttatttctcaagttcataaaaatcctgggtggtttcatgtgcgggggaaggagagagtcctctgatccacagttattcggggatgcaggcactgctgtttcagtatgggccttcccaaattctggacatcaccattccattcctcaggatgggggaaagaacccatagcagcttgtgagaggacagtcctggctgtgctataccttatttccactcacactggttagaagtcagtcccattgcgttttttggccatgcacaggggactggggaatatagtccagcttagtgccctggaaaacgggagaaagtggaccttaatggacaggtagcaatctctgctactctcattcatttattttttattcaacatgttttggaacaacctatttgttagagactgtgctaggtgcttggtttatcatttcattagcccactggcctccccgtagtacttcagggaaacagctaattaatttgtgtctctcatgagataaatgagactccagatctaactaaaacacataggaaacttgacatttcaagcttagctcctttttttttttgaagaaggattacaaataatctggtggtagcattatttttttttctcccttgtgaatcagccataggaagaggagaatttgtgttgtcattcttatttgtattctgtaagaatgcttccctttactactggtattagaggaatgtaataccaataccaatatcactatcaattagaggattataccatagtttcataatcttttcaatgtaaggtagtttaatcagtcaccatccacacttcaacaattttccttttcattgccatgtaggttaaatgaagtcaaatacaatgctcgtgtctcttgtattgcccattcattgcctagcatgtttacctatacaataggcatatgatagtcttttaaatatggaataacaacacaagcagcataaaagattgagacagttttctaataatcacaacatatatcccattttttcttttatttcacttttctttttttcttttcctttcctttttttgaatttctttttcctgcctacctttttccgtttcctttttttttcttctgtttttaagctttaccctgcagatggttaccaatatgattaaaattcttcaagaagcatgcagatctgcctattatagaagggaaaactataaggttacagattctgggtactgatcccactctggccactaacttctgatagtaccttggatagataactttattaattgaggtggttgacctcaatatcctaatgtaaaagatgaagatattgcatccggagtaccacaggcctcttttgtcttttttatataactgctatgttagtataaattgttatttatgagcattagatgagtatttataaaatatgtcagggataggagatatcatttgttgttaaaatcttatttttgaaattagactgcaagaatttgaatctgttgtcatgactttttcaggctatttgatcttgggaacattatataacctctcaaagtgacagtttcctcatttgcttaaactactgtgggttataagaatatcatcatggccgggcgcggtggctcacgcctgtaatcctagcacttttggaggccgaggtgggcggattatctgaggtggggagttcgagaccaacctgacaaacatggagaaaccccatctctaggaaaaatacaaaaaaattagctgggcatggtggcacatgcatgtaatcccagctactcgggaggctgagaccggagaatcgcttgaacccaggagatggaggttgcggtgagctgagatcgcaccattgcattccagcttggtcaacaagagtgaaactccatctcaaaaaaaaaaaaaaaaaatcatagggttttggtgataatttaattagatactgtgtctcttggtataagctctcaataactttgatcatctgaaataaaaatgtcattctctttcctctatccattgtgttttcacagaagttagggaaaatgggatgagaattttccaaagcagcccttcctttttatgtaaaatttagatattggcagcgtatctcagcctcaatggtaacattagggtttgcatctctgttgttagtccaggaatctgtttttctcttttgattctttaagtcatttggataaaatattaaagagcactaagatctgatgttgtagattggaaagaggaaatagttgaagaacatgaaatgtgtctattttacctttatatagctatgcagaacaggtgagatttggtatgaatttgaatagtaacgatgcttaccactcttgaaggatattttgcaaattttaattggtttatctgaacaccacttttaggggctaagtaaatattcccactttacactgagtagatctaacaaaatgatcagtttacccaggtcatttactacattgactattgccaaattcagtatatccagattggacttgctgatcatgcatgcttagtgggtttctttttttttttttccattcttatcctattttacataagaacgaataacttattctctctagagtttgtagcttcatttgcaaaaggggatgcctaagagaggaaagagcaaactaggtgtctttctagcttcaaagattgttattttgtgatttctgtattagttggtttataattgaccagatcaatttgaatcatatgtgtttttctattttctgaattcaacactgttattttctattgtcttgagtactgatgtttccaaatttttaaacctttcccttcttttgttttgttttgtttttttcttccttttttttttggagacagagtcttggtcagtcgcccaggctggagtgcagtggcacaatctcggctcactgcaacctctgccttctgggttcccgccattctcctgcctcagcctcctgagtagctgggactacaggcgcccgccaccacacccggctaatttttttgtatttttagtagagatggggtttcaccatgttagccaggatggtctcgatctcctgacctcgtgatccacccgcctcggcctcccaaagtgctgggattacaggcgtgagccactgcgcctggccttgttttgttttttctagagagaaatgggccccaatatttgccttataatactttgtaccttgtcctacatttcccccttagaacaatgtacagaacagtcaacatgacaatcagatcaagtttcaccttctgcacttaggtctcttacttagctatcactagtctggaggtgttgggaacataacttaaactctttgaactatagtgttctgtaatgtggcattaataaatctgaagtcaaaagatataaaatatgtaaaagcgcttaggagaatatctggcacataatgcatggtagtttttcccttctaagtctgtaggttaagatgaatatttgaagactttcaaactgattttcttccaattaaaatatttgtaaatgatgtataaaaagtctccattctttaacaaaggctgttaaaggctctggtactgttttgattatataaattaaaaaattatgtatttcttataaaatattgcatattttaaaaatgtttttagctcattgaaaatattcagaaaacatatattttaatatcttagcccagaatttgaaatttttctatgaaggtgcaaggttctaagaccaaattgtctctgtagagctgtgtaaaattaaaaaaataaaatttcgaactggccagaaaatgtattgttcttcccaaatcttgagacaaaggcacaaaccctgtttcattcacacacaaaaaataattttgatttgcttagggacataagatttatggctctgtgatgtctgctagagatatgtttaaagtggaccactctatacagctttatataaaaaacatggtatacaccttactgaacattcttttcttacattttcttcctatcgtgattttttttttttttttgagatggagtcttgctctgtcacccaggctggagtgcagtggcgcgatctcagctcactgcaacctctgccccccgggttcaagcgattctcctgcctcagcctcccgagtagctgggattacaggcgcgctgtaatttttgtacttttagtagagactgggtttcaccatcttggccaggctggtcttgaactcctgacctcatgatccacccgcctcggcctcccaaagtgctgggattgcaggcatgagccactgcgtccggccctattgtgatttgttagtctgagtttagattacttacaccaggaggcattttttagcctaaatctgtaatcagttaaacaggaacactttctaaaaaattctagttcctaaaaggcttgacttctacttttattctgctcatttatgtgactggctatttgagtttgaattactggtacattaggaacgaaaataaggaatgcttccttttgcttccagattagacaatataccctgttaggtatgccagtgctgtgagttaaactgagctgtaaagtacaggaagggtagcattgtctgacagaactggaaaatgatggattaaaagtaagataaaggccaggcctggtggctcatgcctgtaaccccagcacttcgggaggccgaggcgggcggatcacctgaggtcaggagttcgagaccagcctggccaacatggtgaaacccccatctctactaaaaatacaaaaattagctgggcatggtggcaggcgcctgtaattccagctactggggaggctgaggcaggagaattgcttgaactcgggaggcggaggttgcagtgagccgagattgtgccactgcactccagcctgggtgacaacagcgaaaatccatctcaaaaaaaaaaaaaagtaagataaatagcttcattgacaattgaggaccttaatatgtctgacattaattttaaaagtccaaggaggcaatatattatgtagtatttcccagacttatatgagcatataacttaactcacagaataatgataatcttatccaattacctatccagcatgtgaatcctttttataatacgcttgccttatatttatccaacctctgtttaaatatctacagtaatgagtaaccatttatagtgatgatgatgatgatgaaagtgagaatgataatggctaagtagtgctttcttcctttatactttctatgcacagttttaactgccttaatcttcccacaaccctttgaagtacgtactatttattttttccatttcacggttgagaaaattgaggcctggagggattaggtaaattgtcccaggtaacacagcacaaatgggtctgggtcctagggaatcttgtcaagaatccataaatgtaacgacagcactattttctctctctctccttctgctccctctccctctctccccctctccctctccgccactctctcttcccccatttccctttgcctcccttcctctccctatccttccctttctttccctccctctccttcttctgtctctccctcttctctcttctccctctcctctcttctccctctcctctcccttccctctccctttctttcctctcttctccctctgtctccctctcctctctccctatctcactccatatatatataaattctgtatacagttactccttgacttgtgttctaataaacccattgtaaagccacaaaattataagtcaaaccattaagttggagaccttctgtgtatgtatatatcacaaccatttgatacctatgactgactgtaataactataattaaaaatgtattcacatctctaattcacccttgaaaaaattatattctctgaagttggcttttctgctgggagaataagattagggcctactttatacggttgttgggtgaatcaaataagctaatgaattgagcttacagcatgtagccgtgtgcatcataaggactcagtaacctttaattgctatcattattattaacatcattaatatgttgttgtacaggaacaagcctaaacgtaggccctggtgtactgatggacctgcttaagttcactacttctgagcacctggagggcaaatgctatgaatcctggcttaagttgctttagtctagccgtggcatgcttccaccaaagttctcatcttaccatcttacctcttccaaagtcgcctaattactcgcagcacataaatccgcctgttagattaaattgtggggaaaaagcaagggaaactgcttagatttaatgttagagaatgccaagaagagacatatttattatgcttattttaatggttttctaacacaatagattgggaaatcatgagtttgtcaaaaacaaatcttaagtcatggtgaattgcaaatgcccagctaaatcaggacttaaaattactccctttgtggaaatctctttttcttctatgacacctgaataggactctcacatctcccatgctcttagcccagctattcaggcagctctcacatgtaaatttgtccctggctcctacaccagtaacaactcaatgtgtgcgtgtgtgtgtgtgtgtgtgtgtgtgtgttcatgttacctctacattatatccttggtttctaagtagaaggactaatttttacctatctttttttaacctatttttgcagatttttcttttttgttagtgcactgccttaagcaatattcttttttaaaacattggtttcatatagccccttctacagtggttgacgttcaaactcatttggcttgaaagtcattgttggttttactgcctccattcagatcctccttttctctcttgcttcgcctcttactcttccttcctaactggtctattctggtattacccagaacaaataaattacattgctgatatcagagtgacctgttaaaagtataaacatatcattttctactttaaaccataatccataactcatatcaacaaggttaatcccaaactctttttaaaaataatctgtctactactcaactttctactcagttttttattttttatttttatttctacactttttatttctacagtaatatcaaatcacttaaaactctcccaacaaacaatacctgtttatagttttgtttatattactcttgttgcactgaataacctattagcatacttaaggcagagtctttgtccttttctccactattacctgagcaatattcctggtgtcttgttcatagcagatgcttgtattagtttcttaggactgccacagcaaagtaccatacacagggtgacttaaaatgacagaagtttattctctcacacttctagaggccagaagtccaaaatcaggtgttggtagggctgtgctccgtctgtaacctctaggggagggtcgcatctctcagcttctgttagccccagttgttctgcagcttgtgggagcataactccaagctcatctctcatcctccatcttcacatgctgcattccctgtatgcctgtgtgttcaaattttttcctcttctcataaggacataagtcttattggatatgacctatcctaatgaactcatcttaacttggttacatttgcaaagaccctgcttccaaataaggtcacattcacacgtaccaggggtcaagacttcaacacatctttttagcgacacaattcaacccataacaatgttccatcaatatttgataaatgaatgaatacatgcattctcactcagcagtcgctcccgagaatccttctttttatgttcagaagagaggttatcaccccaccttcattttataggaattacgtcttactataccttgcacacactacttattaattttcatgtcacagtatatttgttcatatatctatgacattggttagattaggaattcctcaagtaagggcctatatattatttatcttcatatctcattgccttacatggttcccagaagggaaaaatgagtgcttattgaactcaaacattctctgaattcaaactctgaattcaaacatttgcttgaattctgactggattattttccttccccacctcaaaattgcattgctgtctgcttgacctttgtgtgacagtagaatggccaggtggtaaagttgcagtattgagacatacaacccatagtttttctgtctgggcctgttttactgtaatcacttcagacaacaaagaatgctttccccatctggggccagttcccctaactagcaaaatcctagaatgccaatagctgggtttcttggaattagtttaaatcattgtttgcaatatgtgtttacattgcattgaaaatatttgttggaaaagatgttttcatttttagcagtcatttttggagacgtttatgtaagagaagcaaatatcacatgtttgaagctagaaaatttctaaggagtacatgaaaattgcaaagcaatttctgtttgtagcttttagatttaaaaagtgatggctaagggcacattttcctctttagaaacgaaagggaaacatttcaacgaattattaagtattacataagtcttttaaaattatttgagatgagttataactgaaacatatacatagggtagttagtgataaattgagaaatgcaaaaatttaattgagcattggagataattattgcagatatttgagataagatgtagctgcaactaagcgcattcaatttagagattatagaaatcatgcatgtggcaaacccgtgaacctctgtttctctccatctgttggctttgcatctttacttcaggaagactacctaaagggaagaaatagaagttagagttttgaacttgctaaccataagtcgtgtgacttccaatatcagttatagtctactatagtaataaataaatattcattttgtgtgtcatctggaattactcaaatttataaaacttatctgatagtaaatatacaataatttaaatgaatgaaatattgaaaaatatctaaagttacttagatgtgacacagtctattttgctgtatatctcttaaaaatgcttttggtaatgcaagggttctttacaaagtattgtctttgtgaagcagttggcaaatcacttattaaatatttaacctgatgagttagttttattattcttaaggcaaatctttattaagagtaaaaagaacatttaaaaaataagtgtacagcacttgctactactgtgaatttattttttatcaaaagaagtatgattttgtattattttgttttgactatgatgttacataataatggcatccttcttcatttatgcagttggcttttttattgtttaagaaatttgtttatattactatttggttacttaatacatagaagaatatttaataatagagacatttgaaaaatataaaaattataaggaatataatgatcataaacctaaagatagctggatgaaattcactttgattttcatttctaagctcttttccaaaaagccaattttcaaagcaggttttcttgttttattttgctgtttttcctgcaagagttgagacactggttttaagggatacacttccattattcttcattatttcttatgttccacccattatacgtgaactatgtgtatcattagaagacagaaaacaaagagctggtcttcccaagaataaagtgtgaatcaaattgattttaaaattgctctgtgccatgcaagctgtgaagttctagaagagtacagtcagcgtcttggaaaagcctgtgtaaaataatattttggatccattgttttggttttcacacagtgacttaagtgtggcattataatttaagtggaaggcttttattggaaatttagcttagtagagctagattaacaatatatgaaattaaaaaatttatgttttggcagcaatttttgtgttttgtctgcagaaggtccttcaagtggggaagtttcatgctgaaagagccagtacaaactatttctgatgagctgtagatacatttgctaaaaaattttcagttattattgctctaatatgctaaatacatgttaaatctgtttctcataatttaaatgttctggatacaaaaatgcttaagaagtaagtatatcagaactgttttcttctgggatcaatgcattgccattctcagtggatgaagagctgagatttgggataccatgttgcaaatagaggagcccacactggcctcccttcctctactctggccacaccttgctattaattactcgaggataagctaaattatttcattcctttgctttctctcagaataaaatccacactccttgctatggcctgcatagtcttatttagaaatctacctaaccaatggctgggcacagaggcttacgcctgtaatcacagcaatttgggaggccgaggcaggcagatcactggaggtcaggagtttaagaccaaccgggccaatgtgacaaaactctgtctctgctaaaaatatagaaattagcctgggatggtggcatgcatctgcaatcccagctacttgggaggctgaggcaggagaatcgcttcaacctgggaggtagaggttgcagtgaaccgagatctcaccactgcactccagcatgggcaacagagctagattctgtctcaaacaaaaaacaaacaaacaaacgaaaaccaggccaggcgcagtgtctcacgcctgtaatcccagcactttgggaggccggggtgggtagatcacctaaggtcaggagttcgagaccagcctggccaacatggtgaaaccctgtctctgctaaaaatacaaaaaaaattagccaggcgtggtggtgtgtgcctgtaatcccagctactccggaggctgaggcaggagaatctcttgaacctgggagggggaggttgcagtgagctgagatcgcaccactgcactccagcctgggcgacagagtgagactccatctcaaaaaaaaaagccacctaagcaacctaattttaactcttgccactcattcctgcatgttgtgcctccaaagaatacccttttcaccgtgatctatcttcacgtggctgcagccttctcattatgttgttctcggagaaaccttccccgtgatgtatcttcacatggctgcagccttctcattatgttgttctcggagaaaccttccccgtgatgtatcttcacatggctgcagccttctcattatgttgttctcgaagaaaggtgtaactcttcagagaggccttgctttcaactatctttcataaatgatcccagttctactactgatcgccttattttatttttctaatagctcttaccactactgcagtttatcacttgtttgttctttctgttcctccttcattcctctttccttttttcttccttttctttccttttactatggtctatctcccttgagaaaatgaatattccatgagaaaatggatcttatctatctccttcattgatgtatccccattgcctagaaagggaagaacaggaactttacagtgaagaaaaggaacctggcagataccaactgaatcaagtgatcaaaggtagcatgacagtaatgggacagatcattattatgagcttgttgatgggttgcactaagaaaaaaaatttcacggaagtatctaattatgaggaaacatcacacaaagctaaactttacaaaataattgtcctgtaatattgaaaattgtcaagaacataaaagataaagcttgaggaactgttcaagattaaaggagattaaagggacatgtcaagtgtatatgaactatctcagatttgctttggttttaaaggacattactgggacaactggaaaaatatgaatagggtgtttacataataatactatatacatgtttattttcagatgacagttttactgtggttattgaagaaaatttccttgattttaggaaatatacaataaattatttagggttaaataaatgtcatgtctgaaacttactgtcaatgggtttaggaaaaaagagtgtgtgtgtgtgtgtgtgtgtgtgtgtgtgtgtgtacagagggcatagaaattatagaggaaatgtagtaaaatgttaaattttgataatcttggcgaattgaagcatatagtaattatactattattgcaactttctgtaagtctgaaatgatcataaaagttaagaaagatgcacctagttaaagtttctatccattaatatataatcagagggcaaaatagccacacagaagcagcttcaaatactggtgtacattcaatgtgcttactaaaacacatgatatagcattaatgttttacttgtttacaagttgaattgatatgaataccgaagacttgtatttttcctgttgaaataattgtaggtaagctagtagagcttatgggttccacttttagaataacatacaggttaaatattttctatacagctactggttgattaataacctcaataggatttttttccccacctaacttcctttgacgtaaaacaatgtttgcagaattaaagcagttttacaaaagaaataatgttgaccatataaccgagacttcatcaagccactttaatttctaaataatgatgttttatttgtttcttgcacttggaaattttgctcagtgaattgcccgacccaaaccttcaattgaatgtcttttaaatagtttgtactcaaaaatggcattttcttctttcagaaaatattttgttcttcaagtatgtttttgaggttataaaataagagatgcaaagcagaattcataatggttattatctggcataaaattgtaataacaggtgttccttgcagattccaaatagctggactgtaatggggaaccagatttagtttgtaatgggctcagtactgaccttccctgctgcactacctgtgggcatcttgctaacatgataaaatggccagaatccgagaagcacctttgtttatggggttggatacttgccatatcttcaaatataataaccagcatccaatcaaaaatgactgaagcataagagtgaaacagagtgcataataagagtgtgttagagtcatttggtgtgtgctgattttaaactcatttgacatcctgttctctgattaaatccacgcaagccccttttatgactatttttacaactgtactatctcagctctacatggctgagtcattatcaaacaatatatgaagccatgagaaacccagagaaagatggaaaagctttggtattatatgaagaatacaatgaagtagctgtccacagcaataaagtcacagatgaaaaccagatataccagtctagtttattaactcatgttcttctaacatatcccccacacaatatgagtgaactgagccttgtttttttgttgggaagtataataaataaaggatgaaacagacgtgatgtttatatgtaatgccaagttagttagctcaaaatttagattgagaaaaagaactgactacaaaagctttgcattggaaatttacatgacgcagcaagaattctgagctcagagctgcttctcccataaacttttgagaatcaaagactgcccttgatcacaaaaacttaccgtagctagctttttgattttgacccaggaaagctcattgaatgcattctaatgtcccatcagttttggaaaagtggtagtgaagcttcttcgaataggggcttccagtctactctttaaatggggcaaatatggacagcagcataaagcactgagggtgagtttttattcaactcatttcattcaatatgttagaattattgtagctgcttcttatgcatctcagattagaactgaaccatctccaaattgcaccctgctaagcagcgccgagccaagtaaaatgttgctacatgaccccagatcagaaatgctaaatcagatcctgccacactgtctctcagccttcccaaatccacttggctatcttctgtaaggaaaagttagtgtcaagaaagcaaaaacaactttcacgtcatcccctgtgaggctgtctcttcaggaagtctataatcagctgtcctctggtgtagatttggtgattttatgtataaagtcacttagcttgttttctcctggctttagaacctccaacatttcctttgcaatctctgttctccaccttcatatccatcaaattctggtcattaaatgtctctggttggcttcctactcattatgccttgttaccagatgaaaaatatgcacacagtcttcatgttcaaggagaacctctgtagcctctcaatttcttttttttcattttattctattttaaattacacataattgtatatatggggtacagtgtgatcttttgatacatgtgtacattctgaagtgattaaatcaggataattagcatatccacctcctcagatatttatttgcagtgataaaattttaagtcctcttttagctatcttgaaatatacaatgcattattattaactatcgtcagcatgttgtgcaatagaacacaaaagctcattcctcttatttaactaaagctttgtacacttacctgtttctagaactcttgacttacccattctattagtttcctaggactcttgtaacaaagtaccacaaactgggtggcttcaacaataacaatagaacaccaaaactcattcctcctatttaactaaaacttcgtacgtttacctctttctggaactcttgacttcccattatattagtttcttagggctcttgtaacaaagtaccacaaactgagtggcttaaacaacagaaatttatcgtcttacatttctggatgttagaaggccaaaatccaagttggcaggttgattacttctgagagctgtgagccactgttccatcctattcttctaccttcttgtggtttgcctgcgatctttggaatttccttgggttacagcttgttgccttcattttcacatggtgttctgcctgagtgagtacatgtgtctgtctccgcatttcctatttttatgagaataccagtcataatggattagggcacaccctatgaccatatcttaatttaactagttatacctgtaatgaccctatttttaaataggtcacattctgagctgctgaagatttaggatttcatcatttgaattatgagagacacaatttaatgcgtgacactcatcttgccacagtgtcttgaggccttccaccttttaatagcatatggcagatagtaatcagtcattcctttttagtacatttctgttttttacagatgtatatatttctgtctattctactatacttagagaaatattatgtatctttattctagggagatatgcacttaacaaaaatattaatatgtgtgtacgggcctaacaatgtgtgagattatataaagtataataatgaacatttcaaatcatattaccttcttttttaaattatcatccttacataaatcttatgatgttttcaagtatttctgtcttcatcattgaagctatgagaagataagttatatacctaaagagatcaaggaaagataggaaagaatcattgtaagtccactatgctcttcaaataatataatgaccagtatgaactgagataacctttagacagggtagtaggaatcactattgctactacccccatcattgtcactgctcttggtgggtctagatatgttttatatcaattatctgttttaatcctcctaaccctaagagacagctattagttgggtgcaaaagtaattgtggtttttactattacttttaatattattctcatcttacaaataagaaaagtaagactccaatgttggtcagggttatccacgtaaaatcaaacaccagtctattttaatccaaagctcatcaatgaaagctaaattttaggcatattaatgaacatgaatttgcagagtgtgtcgtttaaaaaggaagttgttttttttttaatattgagaatgaaaaaaaggcataatagcatcaatccagagtaaaggaagcccctagaggctgagtaggcagattctagggtttccatgttaacaggaacagtatctgatcagagggacagggctagacctaactgggtgagaagatggaatttcatagatgcactggttcaaagataattgagacttatgtggaaaatctccttttgatctactgctaacccaaagtctcctttattaacagttaatgaaaactgagccctataccacataccaatgtacacatgaaaaaagtgctcacatctttagttacaagagaaatgaagattgaaaccatatggaatgccaatatatatccactgaaatggctgatatgaaagaggctgacagtaacaaatactggcaaggatgtggagcaactagaactctcatgtgttataagtcagggtataaattggtgcaattactttggaaaagggtttgacaggtttataaaaggcttaaacacatctatgctatgactcagccattatgtttattatgtttgtacacaaaggagtttttccaagagaattgaaaacatgtctacaacaaaccttatattagttttttttttttttttttttttgagacaatctcgctctgtcacccagactggagtacagtggcgcaatctcgactgactgcaacctctgcctcctgggttcaagtgattctcctgcctcagcctcccaagtagcttaggttacagacccccaccaccacacccagctaacttttgtattttcggtagacacgggattttaccatgttggccaggctggtcttgaagtgctggcctcaagtcatctgcctgccttggcctcccaaagtgctgggattacaggcatgagccactgcacccagccagaatgttaatagctttattcaaagtagcaaaaatggaaagagcctaggtgttcatcagtaggagaatacataaactgttgtttattcatacagtagaatatgatgcagtggttaaaaatagcaacatgaatgaatcttaatacatggtgagtacaggaagccatacacaaggaaatgcatactgtttgtattcacatacaacaccaggataggggaacataatctatagtgtaataaatgaggtaagccattcttttgggggcaggattttacaaggaaagaatataaggaaactttctagagtgataaaagtattttatatattaataggattatggattgaactatatactttccttttaaatttcaacttttaggatcacatggtacactgtgcaggtttgtcacatgggaatatttcgtgatgctgaggtttgtgttatgatcgatctcatcacccacgcagtgagcatagtactgaataggcagtttttcagtccttgccccactcttttcctctcctctctagtagttccagtgtccattgttcccgtctttatgtccatgtgcacccagcgtctagctcccagttataagtgagtacatgtggtatttggtttttctgttcctgagttaatttgcttagagtaatggcctccaactgtatccatgaatgacatgatgtcattcctttttatggctgtatagtattctatagcagaactataccctttagattgttgcggtttaccatatgtgaagtattgttcaataaaaataatctttaagattatcaagctgtatggcttataggtagctcttgtgttgaagaaactactacatgtgaattcttgtgcttacccacatgctcgtgtaggaatgagcgcaaacacacaggaacaccatataacacatgcatgggaacatattccttatggggctgtttgttgttgttattttttttttttttagacaaagcctcagtgtcgtacaatgacatgatcatggctcactgcagccttgacttcccgagctcaggtgcttctcccacctcagccttctaattagctgggaccacaagcatgcaccatcatgccctgctaattttttgtatttttgtagagattaagttttgtaacgtggcccaggcttgtctcaaactcctgggctcgagccatctgccctccttggccttccaaagtgctgggattacaggcatgagccaaagcgcccagcctagcctgtttttaagtatgaaggataatgagacataaggtagattggacctataatgtcttctcagaaatcatgttaaagacccaccgtatgaaaacagttgggggaatctgcccttttttgcccaaagcagtcctcacattggctttactaccccctccccagcctcccacattttgtactttgctctggacatcctcacgagccagatcctcattgaaaatgagcccctttgaattagctgcttaaaaagatggagctaccatgatgccacaagaaacccagcttgtgcaaaggcagcactaattttaaaactcaagtgttatgtctgggttttttttttttttattaacctctcctagaactcttctgtgctgtcatacataaatcagaagattatgaaagaactagtcaaagtggctgtttccttctaaggctgtaatttggttccatgaattattaattattagactgatatggcatcagctcctcagaacccaatataaatgcaaaagcctcaccttatcagttataatctaaggagctgcagtaatgtcattcttcccatttagtggtgtgttatggggtttaggatattcaacccaacaaacttctgaaataaaatacaaagtaaaggatatttttgtgtgtgacgagatttgaaattcagtataaggaagcagatgtggattgcttcaagggttttgattgttttgaaggatggagttgtttcatagatgctaaagcaaataacagggcatgtaaaagactgtggttgaagaaaactgcctgaaagtaaagctttggaacatcttgcatctctgctgctgttagggaggaaataaataatgcaccatggattgaagttgtgctaaagatacattcagtatatgttgaaagcaaacatctgatatagtaagtatatttttcttatgcgaattacagctcttatattctttgaagcaagaactaaaaacgtattaattttttgtttgtttgttttgctggagtacttagctttaatacttgatgatgcctcccagttttctttggttctgtctttaatatgtaatgtcatgttattttaaaatgttctgaagaaaaaaatttataagcttaaattctgttccgttttgtgagcacaagattagtctccttttaggtgcaagtttttttttttagcagtttctggatattttagaagtgtgctcctcacatatacatacatctgattgtatcaaatacagactacagtatgcagctaatgttgcaaacgccacactgctcagcattgcagtataaagaaggaagtaacacctaagctgtaatgtagccaatggattgggggttctatgaatggaaattctaaccaagtagaaatatatgttggagttagctatgctaaagtaaatgtgttctgtttcactaacttagccattctaagagattatttagaaataattagtttgctaaatctctgcaaactttcatattattcatagaaatttcagtagctttgttactctgagcacactacagcaaccccagtgctctttgacttaaatagattacattttttaacaaattattttatggggttgaatttggtctaagaaaatgaagagtgtattcattctattaaaaaatggctaaatatgaaaatggcttgagtgataaaagtaccttgactatgctctactgtttctatatagtcagttttaagaaactgacaaattaaaaattttctcgaactctctgtaaagttaaaatattaaaagtcgagacagttttcttcattaggcctgagaggcaaaggtgtgatatattagcatttgaaaaataaataacagtgcatcaaaaattatgaaaacttttaagtatgcttaaagaataggatttatatccaaaaagtttcctgaaataaatagattgtgccacataatttatgactcattaaaacaaaaacaaaagatgatatttcttctttagtgtgaaataactcattttctattttaaattaattgctttctataggcaaattaggggcaaatattcatcagaatggcaattacttgaaattttttcatgtttaatatggtactgttttcagttcattaatactattgaccaacagctactataaaaaattaatacttttccaaatttactttctgtatgagagattgattcattatattgccattgaggggaaaaagctatgtagaagtaagtttactatggacaggtttagtcaatactgtgttgagtagactgtgcatgagatatagggtagatttagacctgaattaacagtgcatcagactatgaaattttgttcagtattaaaacaaaattatcttgataagcatctccaaaatcacatttctggcccatcattgttggggtgtataccacggaactgagagttccctgaaacacttggaaatgatcactgatctggacttgatcccaaatgatggggctcattctcctttcaattttgctaacttattttgatctcctgccttcagttttaccagagatttgaattatgtatttggatttgcaataaactatagaatatggaggctcaggcgtttccatatattgatttattacatacatcttaagttttaaattggccaaatcaaaggtagtaggtttaaaacccatatggtaacttaggaatcagacagcatttggggagaagcaacatacagaaaatatcctttggtccaacccagtcattaaaacaagaaagagctattgaactggggaaaaaaagaaagaaaagagaaaaaaataatatcctttaggttagagtgctggctttccccacccaatatctgtgtcagtttctctggggtccctttctgttctggtttgcccttactctgggttagtttagattccttatcaccagccatggtaagccatagtaagcatgttcagcttcctcacttctgtaccctatctagtgtcttatgttatttttgcccctgtaagtttgagccattgtaacttctgtggccatagtttcaagactatgcttatgatgtggatgaaggtgtttttgtttttgttgttgtttgtttctttttctgtgggataccttaggattcattcatttgtgatttcagaatggagtgagagagagctgtttttgaaaataagttatgctaacttactagctgttactagttacataagttctctgagtctctgtttttttctctatttgtaaatgaaaatgttaatattaactatcttatttgattattgtgagaattgaatgagataacacatgtaagatacttggaattcaccctccatatactaaatgctcaataaatctactatgttcgagtatgatatgaggaaggtttatgcttctctaaaaatcactgcaattaattctagtttgggttaataatggatttggtctgttatatggattctaagtggaataactatgaatgttatttaaatgtatatttatatcaatgaagagtgaaaatcaaatggtttcatcattaccagcttaccacataatcatgctgtggtggaaatctacttgtaaagagtaacctctgcatttttcttcagatacaatcaataaatgtgagtgatttcattacttatgaaataattcaggaagaaatataattgtgtgcatcatgtaatataattgaatgtggacagacaaaccaagactaattacgggcttgggttttcccaggaaatatttatgtaagtaacttctataggtggatatcagtcctgtaaggattttgacattcttctgccttcagtaatgcagcactttctcatcttcaagagctagctcatttgtgaagctttcctgtgtaaccctaccacgaaataatatttttctactttaaacaattctagtatcacaaaaccagaagcttgtttctgtgctattttgaaattttctccatttttccataatatatatgtacacacacaaacatacacacacatatgtaaaagaaatatatatatatatgtgggtgggtgtatgtgtgtgtatatgtgtgtggtgtgtgtatgtgtgtgaatatatatatatatatatatatacatatatatatatatatatatatctctttttttccttcttcttaaattttattacaagatattggaatcacatgcttaccatccacccttcctcctgccacttggtggatatttgtatttctgtagatacttaagtaaacaatatagctcagcttcaaaagtcttagttcaacaaatcaaataaaaagatgcaaaatgtaggtttagtaacaagttaatgttctcatgtatgagtaatggtgcaaaagccatgactattataattttttaaatatttgaagtgttgtacctataagcaaagaaactaactttgtggtggcttttatttcaagttttccaatccttactttaaagacatttggattatgctgtgcataataggagaaatactgccctatgttccaactttcaatttctaaatttatttatatattactatatataagtatattattcaaaccccatcacaggtttgaaattaaccctcttggggaacatcataatagttttcttcttagacttcttataggataggtgtgtattgggaaattagcacattacttatttttacacataaataatcacttcattttaattttctgctctgatttccacctttcaggtatgtataccagatactgaaatggctgatcccactttgatcacctgtattacagaattaggttattttccaaatttgacaaaattgcaattaagaattgcttcttagtagactttgcagagtatctgagttacgttctttggatctcatgattttagaaatgtttagagaacattttgttcattccactaatgggaagatagaccccaagaggtttctcaaggtcagagagcctgctagggaaggagtcagacccagaaatcaggtctcctgacttcttgtataatgtcctttttagtgtaccatatttcctcagtcagatcgatctactcgtccctgctgacattcagaaatctcccaggtatttgtagataatgtagctagtggctattttggagcatcagtctagaagttaagataataaaatagagttttcactttattatgtttttgtgtgtaaattatttcacaacttaaagctttatttttttctgtaaaataatcataggtttctaatattttggcttttctagttttctcaaatgacttgattgaagacaatctgagtaattcaagactagagaggcaaacaagaaagaaggaagaattatttcattcttattaggagtgaacagtgcacatggtttgaagttttcatcagggattccgaatctgttgtttctatagctaataatagattgctcttcagataggctgctaaactttgtagaggttaaaactttcaccacacgagtgtggctgtttgttcaccgcagtgcattgccaggtaaactttaaccgaaagctcaagagatttgatattttaatcctacaaaagcaattttgtttgccagcaaagtaatacctggatttttagtttctcagaggagctaggcatagaatttaaaatgtattagagctgcccttggggctaagaacatctgctggactgtagtctaataaaacagaatctgacaaagatgaggtctatgacatgtactctgctacaaccatacttgagtagatcaaacgggttggtttgacaaactgatcaagacaacaggcttatggaaactgcctcactaggacagctatcctcttccttcagggttctgccccaaatctcccttgcagctgaatttaatgggattttatcatatccccaacatgcagtctaagagctgaactcccacctcttttctgtttgacagaatctctcttatgagcttagggataaatattgggacttagaccaaacaaaaattggtgaaatttttggaaaggagatgtagatttaaacttagaattgtcaggttcaagtcttttcctcctccatctctgattttttattttagatttttaagtattatgaattcatagtagtcgtacatattaaaggggtacatgggatattttgaaacaaacatacaatgtgtaattattaaatcagggtaattgggatattcatcacctcaatttcctgtccctccatttatctgtattaggaacatttgaattccactctttcagttattttgaaatatacaataaattattgttaactagtgaccctacttgtgctactgaacactagatctttttccttctatctgtattttcgtactcgtttgccatccctctttatcccaactctgattttatctaagcctctcaatgtgtcttatatctactagtttcttataaaatatagtaatagcaattcccaccttctttatggtacaatgtttttctagggaatttaatatacctaaagtatatgaaagttctttaagcaggttataccttacgcagtacaaattgctgtgattgcaatagttccttgtgtatctcatcttttgaagagaggagtgtattaacttcctggagctgccacaaactgggtggcttaaataacataaatttattgtcttatcgttctggaggctagaagtcagagatcaaggtgtcggcagggttcgtttcttttgaggtctgtgagaatctgtcccatgcctttcttctagctttgggtggtttgatagcaatccttggccttctttgtcttgtatcacgccgagctctgcttaaaccttctctctatatactagtctatgtccaaatttcctccttctaaaggatgccagccatatttgattaggggcctgctctactccagtatgacctcatcccttacactagatataacctcagaattatatctgcagtgaccctatttccaaaaaaggtcacatcctaaggtactgagagttaggacttcaatatattaatgtgaagggggacacagttcaacacataacaaggaacataacattttttttgtctcactgttcttaacttactgctgcttttactcaaaaaatttgggatgaccatgatgtttctggatcttcccgtccctctgtccctgctcttcctgtaaatctcaacctactttctaatatatttcttgtataatctcaaagtacaagaatatgcataccataagataagcactgaataattgtaaatcactcttagtaaattagtagtctaggctaatctgattgtcagctgttaattttgtggtttctgagaatcatcaaataatgtactcaaacctgctgattgtttatatttttttgaactacaaagaactttcatttacagtattacatctaaaccaacatagttaatatttatattcttatcaaagatgtcaaacttcaggtgtagaggtgatgaaatgccaaaagtcacctggctagtaattaatacagcctgaattagattttaagagtttttaatttcaaacctagaattctttctgctctatcattatgctgctctttagaaaatgggtatagtaaggtttgtgacctctgtttgaaacccatggaactacatagtggaccctatgagtacagattgtccatataatactttctcaatttcttcacatcagacatttgtgatttctattatctatccacagtggttattgtgcatgaggctctatagttgacataaatagtgaaaagaattgtttcatttctctgaattgttgttctgcagaaacctcatgtatttgttttctagtgctgctctaatgaattaccacaaatttagtggcttaaaacaacacccatttattagcttacaatatttatggatcagaagtgtaaacacagcatggatctctgcttagggtctcacaaggcctacagcaaggtcgtgacaggcctttccccttcctggagctggaggagaaaatttgttttcagtctcattcaagctgttggcagaatccagcaggatgtgattgtatgattgaggccctcatattttgctggtttttggctggaggtcattctcagctcctagcatctgctcgcataccctggctgctggccctcttcaaagccagaaatgatggtagagttcttctcacattctctctgctctccctttctacctcatctgtcctgcctcaccttctcctccacatatttctgaaggaggctcttctgtcttccccttctgcttttaaggactcatatgattacattgggccaactgattatctagggtaatctccctgttgtaaagtcagctaattaatcaccttaattccatctgcaaagtcccttcacagtaatacttagatcggtatttgatagaataatcagtaaatgggaacctttgagggacagctctagaattcggcctataacatctcagtattttttttctttttgcattaagcattttcaaatcagttctttacccccaaaatcatgttgtttagaatgtactaggtgctttcaacttatgttattcttatggcatctgaatgggatggagacagtcatccccatttcttcgataagaaagtaaaggcaacaagtttaaaaggttttatcagatacacagggagtataatttaaagtatatcagagttcttctcagtgtaaagtacgtctgctagtttttaacataataaaagataacaagcccttattttattctttctgttttaatcatttatgtaattgacttgttctttccatatttcttcccaatgtatgaatcctatgagattatcatccagtttcagagcaggggcaggaattgtttgggggagtaaaaatacatggattaaatgcctagctcttggtcagtatggtacatatatttccaagctttgtttggtgagagagcttgaaattaatgacaacccagtagcaatgagcacacctaggactcatatcttggtatttaaatatcagttcttcaaatgctctttgaagtagctgatttcaaatctggggtagctatagtacaagatgagcctggagcaactttggcactaaaaagttagaaagtcctcaaaaagtaagagtgcatgtcaaaggacataggcactgacatgaaagaacccccaatgaccaaagctgcaaaattggagcaacccaattaataactatagttatttatttaacccatagaataaaatagatatatgcgaacccatactgttatagataggtagatagatagatagatagatagatagatagatagatagataggagtcaaggatcagctcttccttccagaagaattataattaataaatgaattatagaaggaataaaagaaattgaacaccatcatcaaaacactatgttaatggctgggcatggtggcacatgcctctaatcccagtactttgagaggctgaggtgggtgaatcactcgagcttgagagatcaagaccagcctgggcaacatggcaaaatctcatctctacctacaagaaatacacaaattatctgggtgtggtggtgcatgcctgtagtcctagctactcaggaggctgaggtgggaggactgctagagtccgggaggtcaaggttgtagtgagtggagatcacgtcactgaactccagcctagatgacagagtaagagcttatcttaaaaaaaagaaaaaaaacagggaaagagaaaaaaaaaactatggtaataattgttgcagatgagatacactggcatgctaaatcttgtggatgaaagttcaaaaaaaacatttcttactctcaaagtatatcctcccaaaatttattaattataaaggggaaatgttaaatttcacattggaaaaacccagcagataccaccttaatcaagtgatcatgtttaatatcaatggtaagacattttgacatcatgtacccctgacatgacacagtgagaagggcacatcagttctgtggtttcttgtgaaaaatatataacttcaatctcatcatgaggctgcaccaggcaaacctaacatgaaggacactctataaattaacttagcatcattcttcatcgtatcttcatatcacaatacaagaagaggatgttagtgaaaccattggtaaaatccaagtaaagtttatagtttgttccctgttttgataattgcactgtggttatgtaaggtatgaaccttggagaagctgggtgaagagtgtatgggaattctctgtactatttttgtaattttttaaaatataaagtaattttttttaagtctggctctctcattaaatagctttgtaatattgtacaacatacctcttttgagtctcacattgtccatctgtaaagtttgcctaacaatacagagcctgttacaaagtatgtgaaatctaacagagagacaatgtagcctcatagttaaaagcaattgctttgaagtgatataagtgtggttttaccagttaaaactgtggaggaatgcaaaacttacctaactttattaagcctcagtttccccatttttagtactcagatgcacttactgtgaatcttaaatatgatatagcaggtaaacatttaacccttcttagtaggagatgaactgagaatgaggaactacaaatttgaatccaaagtcttaaattccagttgcacttattaggatttttttacatgaagcagatattaaaattaagcatgcaagatatctttcttcgtctaactcacatattgaagtgaacaacttttatttagggagtttttatacaacagcggacaagggaaaatttagctcgtgttattttgaaagtggcaggaataaatgtttgattaataagattacaggcatatttgcatctggagagaaggttcataaaagagttatttttacttgtaatttatttagcttgaaacagagggaaaaaattgagattaatcagttgtcaaataccttctgagaaacccaaatatacttaaagaatcatgctgagatctgacatacttctaggtttttaaaggaattttttttttctttttgtttttgttttggctaatcagtttatgaaccactttgtctatgggtaaaccaagatctgataactctcagaacagaactttcataaatctgtctgtggaaaaatgcctcaaaacatataaaaatcataaaataaagggaacaaatataaagaacactggagagggatttgggtgttgtgtctgtatttttgcagtcttagcttcatgtgctgcctgaccacatacttcgtacttgcttcctcctctgtcatttgagatgttatttggttgtgagaaggtggaaatagcactgtatgttaaaattgattcccaaatgcgtcaaaatgtcgtatctgtggtctgatggacaacaaacaaatgcaatcatgaaaagttattcccatcctgacaagactttaagaaaatccactattttgagaatgggtaagttaaaaaattactacataaaataaatcttcccttcatgtaatattccctatgtgatgagtctaaattgttggcagccatactcctaataatacacgtatgtacatatctgtgtgtgtctatgcacattttaaatacttgtgacatatttatttaaagtttatttatgagcagtatggtagtttaaaaggattatgaaggtcattctgtgtgtcaaacgttgttttaagaagaaagtatctgaaataaagtagcacttatttgttgctttgtttttattctgattgcagacaactgtgtcatacagtatatgaccaagtagatatttttctgtacatcctaagagagggcttggactaggccatttctgtattgatatcctgagacctacatatccctggagaccaattacaaaggttcacaaggttgtttttattttgttttctcttgattcctttttaatgaggtctcccagtaaacagcaagcatgatgctttcctgttggaggcctgtctgccgccttcaaccatttattactaattcatctgggaaatgatttataaattaaatattaggaaaatgtacttgaggaaaaaagtggtaagaggtacaatttataattctcatttaggagaaagtcatgccagcagtttgctaatggaaggatgctgagagtcactcatagaaatacagttgtggtttatgtaataaatagagatgtacatgaagagaatcttcaatgtatatttttgggcatgtgattcattttaataaattgtgaagacagaagttcccaatttttctcttcaagtgaacccttggaaaattgggaaataataaagagcagaagtgacctatcaatatgtgctatctcataactcctcctcatgacaaaaatatagtatttatcaatactaggtgaaaatagcttcatcatagaataaaatgtggtgttagtagatgtcagtgtcatcatagatttgtgcaagaagggattccagatgctattttagaacaatcttctcattgtacagatgatgaaactgaggtcatccctgtttatgacttacctaaggtctcataacttttaagatattaaatttttgagattatttataaagcttcaagatttatttttgcacttgtaggcagtttttgtatgaaagaaatctgcttttcagctaatcagtcagattaggattgtgtcttatgagaatatcttttacatttgcgttgttgaaggaagatgaacaatagctgtgtctctacacccagaattaaagaggaacaaaattatagctttggaatcatcttctaaaattttattaattccagggaattaaagcacactcatcttgcaggttttatttaataaaaacgtttgttactttttttaaagttctgagtaatttctaggtatcttttcttttcttttttttttttttttgagatagtgtctcgctctgtcgcccaggctggagtgcagtggcatgatcttgactcactgcaagctccgcctcccgggttcaggccattctcctgcctcagcctcacgagtagctgggactacaggcgcccgccaccacggctggctagttttttgtatttttagtagagagaaggtttcactgtgttagccaggagggtctcgaattcctgaccttgtgatctgcacgcctcagcctcccaaagtgctgagattacaggcgtgagccactgtgctcggcctctagatatcttttcaatactgctatagtggttgcattatagcaatcattaatctcaaagatataagcagtgaattcataactgtgaaatcataactttgtggttaatatttttttctgatcccattttaatctttttaaaatttcatttctgtttgaatatttagactgtacttgaatataaatttcaaacataattaagcacatgttatctttatttaaaagatgaggcatatgtatattatctatgtatacactatttaaatatgtccatgtatacataaaattatatgttatatgtaattttctaaattatatatatatactgaaacagacagatacagtttatggctgatattttctggtgaaaataatttaccagtatgggtttgttggtgtctggctgtcaccactaagaaaagattctactgggtcattataaaaatttcagtttgggggaatgttaatagaaattagccatattatagtttggacagcacctatatgcagtttcatttaccgatattaacttagcacatgctggtttatgaggggaaacagaattcagtggtgcacatttaatcatttttctttatctaatttaaatcatattcttcttgataaagtgttatcttggccaatgtaagaagatggaggaccctcccatgaactttgtgggacagacactgaaaatctgtgttgacagcatgtctctaactcatccttctcacaacatttgctgttggaatagaacagagaattctgtaagagtcatagtttttagataaagattgttacagaggcataataattccagaagatttccatcttctaacaatctcttgaaatcaataataaagacaatggctttctattcgtccactttaccacatcaggcagtggaaatagaaaatgatataaaattaatcccttctcttgacaattgtaaaatggtaatcctccattttatcctctcagaggatatttgaagataacttttttattatcctattttcatattctgtctcataacctcatatattgtatagcccatttcattgctggtggtcaaataagactgcggtagaaagccacaggtaggttactagggttctgaagaatgtatcagcacagaaaaccaatttcagatatattttcaatgttattgctttagaatacatctcctttactgagacatcaaaaatcaaagactagatgagctcattcatgtgaataagcttggggataaattacctctttctagtttcatattaaaagagcagtagcatagtcagcctgactgtgggatcttggtcaagcaaagctaaatgttcttttcctaatttttcatattatttaagtgtagtgtcagaactattccttagtgtctttgttagttttgctcttaactgtagtctcatgtgttcagaatgagcaccagccaacaaatacagacaaatgcaatatttcaactgtactttacatataaaaagatggtgttaatacactctcttctgtggttattatgtagtttacttacaaactgacatgcatttttctcacttataagtgggagcacgtatgagaacacacagacacagggcaacacacactagggcctatcggggtcaggggcaggatgagggagcacatcaggataaatagctaatgcatgcagggcttaatacttaggtgatggattgataggtgcagcaaaccaccatgatacacatttacttatgtaacaaacctgcacaccctgcacatgtatcccagaacttaatagaaattaagctaaaaagaagaaaaactgatatgcatgatgcatgcttatttcttcagaaatattgagatgtttatttaatagatgccataaagctacctgaaatctaactaagagaatcctagtttactgcatttgttggcaaaaaagtagactattgatataaaatattttgaagttgcagccttacatgattgccctgtttagttttttggaatgtcttttcataaggaagtttgattctttaaacttggaattccaaaattcccagtactttcaatcaatggactaatcgcttccctgcctgctgcctgcctgcctgccttcctccctcctgctctttctttcttcctttcctttataataaaaaatcaagttattggaaaaagtattgagtcactttattctttgtgtcttactatgtaagtttcaaatttttgtgcctttttgcttttattctgtcgttgctgtatttcgaagcatcgttttccccttttccattgagatgtagtatacataatgtaaaaaaccccttaaatattacgtttcatctattgctccatatatgtactcatgtaaccactaccttgatcaagatagagaatatttccattaactttaaaagttctcttttactccttgtctgtcaatacctcttctatcctgaggtaatttgtcttctgacttctatcaccgtagattaattttgcttgttcttggacttcatataggtggaatccaaaagtacgtactgttttatgtctggcttattttgctcaacatactattttttgagattcttttgtattccatgtatcaggagtgtgttcttttcattgctgtatattatgtcattatatgaatatatcgcaatctcttcatcctcctcctagtgatgaatataactgaagcaaatttacaaatactttttttttttttggaggcggagtttcactcttgttgcccaggctggagtgcagtggcgctatctcggctcactgcagcctcctcctcccgggttcaagtgattctcctgcttcagcctcccgagtagctgggattacaggtccccaccaccatgcccagctgattttttgtattgttattggagacggggtttcactatgtcggtcaggctggtctcaaactcctgacctcaggtgatttgccctcctcagcctcccaaagtgctgggattacaggcatgagccaccacacccggcccagtcaacagttctcgtgtcagatgggtgtacccacgtggggttgtggtttgctcttctaattcttatgcaatagtaatgagtctttaaaacaaaatcctgtgtttgaatgttcttgaaatctcagaaattatctagcaaataacagggcttttttttttcactgcatgtgtgcatcatacgtatatacctttgtaactgaaaacaaaaggtagaatcgtatagtagttaggatagaaagctgtagaatcagattgcctgaatttgaattacagatattctacttgatattgtgtgagttgaggcaatttatttatattagctgtatcttgctttttaaaaaataaaaaaggatattagaaccttcctcatagaattgttttggtgattaagttagactttaccttcagagtagacagtaagcactcaataaatgttaactgttattgttccaagtatgtacattatttttattcaaaaatgtgtgcaggattccatatgattctacaggattccatatgattctacatacatatgcatcgttaaaatgtactatgtagattaggttgatctaatgactgtcttctctaaccaaaattgtcagagggctaactcttctcactcattttggctcttgtatctctactttagtggaaccaaagtgaatgataacaaccagagagagattgcttcttgactacaaataatgagatactccagtttaaattagttcaacaatgttcttgatcaaatcattctcaatcacttattttcagaatccagatattactgctgtgaataacaaaagaaaactcaaatttctgttcttgaagcattaagcctcttgatattgggaaaatggtgttaagtgtgaaagaaagacagccatctaatttgttggacatctaggtgtgtcatgctaaattctttagatttgaaaaataaatttttcatagtatttttctattctgaaaatatttttatataaaccatgatttctttttttttttgagacggagtctccctttgttgcccaggctgaagggcagtggcgtgatctcggctcactacaacctccacctctcaggttcaagtgattctcctgcctcagcctcccaagtagctgggattacaggcacacaccacaacacacagctaatttttgtatttttagtagagacggggtttcaccatgttggccaggctttggaactcctgacctcaagtgatccacctgcctcggcctcccaaagtgctgggattacaggcatgagccactgcgcccggcccatgatttttaaaataacaaatttaaattatttttctgactacctaccatttatagctgtaagtgtggattctttcagttaaatatttaacgtgtttggtgccaacaactcagtatttagcctaatccctatttcagaatccagagtctatattggtgccattcgttgaataccgaggatggcacagagctaaacctccatcaccccatagacagtggggacagtgcctccagcatacgaatgatataggtagagatatggctgcaaaatggtagatgtgactttctgacttgagggatttcagggttttctaacaatgtaggatggtgggtagataccaaaggtccatggctttcatagaccagtgatgatacttgaattatttatgtaagtgtttcatccctcctattaaactgcaccttctttgggagtaaattttaggtattaatttgtttcttctacaccatttagcatattgcgtgcgcttagtagatcccacataaaaatttctcattaaatgaagtaagcatataagcctaaaaagtacagtgaaattttttaaaaatgccattttaaaagaatatgacaacaaaaatggcatatgtatgcattaaataaatatgtaaaatgactctcaataaaatgttaattgtgtagttatttttggctgggaattcaagtgattaaaacttctcttttttgtaattatatcacttgttaatagtaattgatattatttatattatcagaaacaaatgaatatgatcatagtagattataaaggaaaacataaacaaaccattaactgtagaaaaatcaaaattttcaaagctacttttcccaaaattatcatacctagacattcaaggagttgattttgttttgtatttaaatttttctatagtatggagaaagaaggaatattcaaaattatttttataaagccaccattacattaatacaaagatctgccaaacacagcccaaaagaatatttcagatcaattatacttaagaatatatgttcaagaatcctaatttaattcatcagattatttgtacattaaaggaaaagcacatagaaagaaaataaacattgagtgagcctcgttgcaaaactcttctgatatttcaaaattgggaagcagtttcctttccatgtaaatcattatttccaatatattaagtataatacaagtgtaggtttaatcaatttctattttggtaactcatttaagagcatcactattttttatactgtggatgaggtattctgacttctcagttgccttaaaagagtgccagggagtcatactgcagtgttaaatgtgctcttctgccttgcattcatgctaagaaaaccagtgtctattatgtggctcctcgctttagccttctcagcatgaatgaccattcaaggagcaacagtattttataaaagtattgattgtgttggtttgtaaagggccccataatgttcttcccacatcaaacctgtgctctctgtgtaagagaaccataatagctacagcctcctggtaatgtatatgaattgtacagaatttcagtttatggatcagctttgtaatagtgcagagtttcacttggcttaaccaggtgtgggcaattgttgggtgcctttaaaaagtcataacatttccagggacagggatgtaatgggtcattttataagaaagaagaaaatgtattaaacgtaccacattatttttagttcaatggtaggtgtaagacagaaagtacgtttgcttggtatacatttctgtgggacccagtgtttggctttggtctgctaatttcctttgccttttcctatttaagtttttttcttttattcttctattaataatatgatttctataagtttcagaaactttctaaacaataaagtactccatttctgcactattgaggttgatgttggccttatttattctcaccttttttttaaatttggtttttgatttgggatttggggtggcgctggcttattagcgttcttggttgcagcacattttcctccttcagtaacaactctagaagcttaataaccaaagttataacctacatttgttttactgtgctctaatactcttaactaccgggcagatttcagtataaggtgaattggcatgagaattgtttagtcaatcaatagccatttaataagcatttggttacatgttttggaatttttaagagacatataagatactagtgtgccatgttctcacagagtgaacaatctagggaagcaagaaatatatatatatatatgacaatggttttaggtaataaaatagaacttttaaaataagttataagcttatttcctcatagtgatcattccatatcacaggccacctgcatcctccataaaagaataggattcttaaatttgatgtttaatagattgtgtcactttacattagccctaattaactttttcctagtaattttgtgaccttcaaaatttacttaatttatcaatgccattagtttttcatttttaaattggagatagtaggaatatctgcgttatataacatatgtaaaatgtaatttaaatatacagaaatgaaaattgggaggtaatctaaccatcttgtgttacatatgaggaaatcaacacactgaagtaggaggcttccccaaaatggaatattgagcttcattagtggatattacatttgttgactcttcatgtttcctcattggagtttccagatgccactcttgcttctgaaaatcgtgtatgacttgtgatgtaacaaaaatcagagggctttccagtgtcgcaactttcttttttttaggacggagtctctgtctgtcgcccaggctggagtgcagtggtgtgatctcagctcactgcaagctctgcctctcgggttcccgccattctcctgcctcagcctcccgagtagctgggactacaggcgcctgcaacctcgcccggctaatttttttgtatttttagtagagacggggtttcaccatgttagccaggatggcctcgagctcctgaccttgtgatccacctgcctcagcctcccaaagtgctgggattacacgcgtgagccaccgcgcccggcccagtgtcgcaactttctatggtataagagttactttgtttagcagaagtctcacagtttgagaattaaccttctcagtggagagctggcagactggttataaataagggcttcagctcccttagtgtgggacatgctgcccgctcccttcaggtacttatctgtcctggaccagacagaagcacatctgcttttcatttagcttacttccatttctccacttcctctcttttgtcagtgttaaagcttaaaatgatgaaacaatccagcagttatccaactacagataaataactgctggactgtatcatcgtagacagttggtgaaaaattctagaccagaatccagtcccttcagtcttgtattctttctaatgtattgagaacaagacaggaacattgattacctatttttagctggtttcaaaaacagtaacctcaattccacaatcaagatttggattcagaaatactgagtttgcactgagctctttcctgcttcactttggggtcatgagaaaggctgtgaatttctgcttcattccgattccctcattttaataacctgccaggagacctctaggggagtgattgtaataaactagctaataaaatgagattagaaccttcaaaactaaacatcctcttatgatacaatccagcaatcacactccttgagatttacccgaaggaggtgaaaacttatgtttacataaagacctgcacactgatgtttctagcagctttattcacaattgccaaaacttggaagcaaccaagatgtccttcagtagatgaatggttaagtaaactgtggtacacctagagaatggaataatatttggcactaaaaagaaatgagctatcaagccatgaaaagacatagaagaaacttaaatgtgtattactaagtgaaaaagccaatctgggaaaaaagctatatactttattattccaactatatgacattctggaaaaggtagaatgactatgggaagagtaaaaagatccgtggttgccagggatttggggtgatggagagattaatagagcacagaggatttttacggcagtgaaactaatctatatgatactataatgatagatacagatacatgttattacaaatttttccaaaaccatagagtgtaaaacataagagtaaaccctaatgtaaactccggactctgggtgataatgatatgtcaatgtgggttcactgatgataataaatataccgctggtgaggtatattgatagttcagagaggctgtgtgtataggagggcaggcatatatggaaaatctctgcaccttcccctcaattttgctgtgaacctaaagctgcctagaaaaaataaagtctgttaaaaaatcaccacagaggcaaaatgtgagattagaacaacctcttcaaaataatacacagaaagtatttacaaatgctaactaagacatagggttcaaaacgtaaaactgctcacagcccaggtactaaaattagatcaatctaatcattagatactcaatcattagatacaatagaatttgccccagtagcaaatgtttacttttgattctgttatacactacttaacatggtccagtgtcagcataaggctgtaatttggcgattgcatttctttatttaataactgctgataaagctgaaataaagaatcagtaaaaaggtttcacttttgtaaagcacatccagggtttataggaaaggaaatatttcagcatttctgatatataaaagaacaaaggtgttatattaagaaaaaataatacataaaacaatatcagggacattgaattgatgaaagtaatcagtaacattttaaatccatgttggcttgcattgtgaaagaagggaataatttacagttcatgatatttgtatttagatgtttgtatttttattgtgtttagagaatcccaggaaaggaaagaatcctacaacccgtaggatgaaaaaagctttggatctcatgccaggacaagggcactgatgcccaaaaagataaaggccttcctcagaatcttatgggaaaagtcaaattatttaaaattagctccagggttcatgagtaagattaattggtagaagttaaatggctatatggttcacgtttaaaaataatttctaaaaattggataccccttatgagagaaaatataagtggctttgagtaatagtttatattccaattattgcaagtaatcaatcatataccaggtaatttcctgacatgagttacataccaaaaattatattggatgaaaagctcgaatgaatataggtaacattccactctaatgtagctttctgtatcttagaacattcaactttattaagactttatagtttttaggaatagagttaataaagaacttggaatcttctatcaagaaataaagaggtgggagtggggagatctacctctggagattctcatgtgttcaggatatattcaacgtttatttgttcctaggcagggtacagaataaactgatacccgtaagtccattctagcccaatgtttcaaaaaatgctggcattttagtgaaatgtaatatggataacataaggtaacattgcgaatagtgaagtctgcaactaaaagataaagcatttaaatgtcaaatagcattgtgtaaataaatctaaaatgaaattttcaaccagtttttaaaacttacttccactaacaaacataacatagtgtcatgcagaagatgatgaggaagcaaagaatatgttaaggaaacctgtagaaaaccaaatgccttcttgtattaaatgagtttaccatgtctttcaaggaataatcatgtttatacaaatgtgtgtggtttccaggacccatttttcttttccttccctatacatgcaaacatatacaaatatatcagctcacatacttatttccctgtggtttcagactattaaatgtttataattactctgcttgatgactgtaatttttagttacagatcgaattgtcccaggtgtggatgctgccaaaagccacggtcattggcaacatgacatctggaagacagtctggcatgtagagtcagggaatttgctagaagttgttcctcatacagtgcaatagtacaagcaagcattgtgactccctgcagctggtgctgtcagtgccctatccatatgcctcagacctttaattgtgtttctgaggaatgcttctaactcctagtatctgcaggtttgttcctcagcactttttccaaaaactgtgggaaattgcactgcttatatgcacaagtgagcttcatataaggagaaagaaaaccctctaggaatagttcttaattaatgactctcaagaggtgctgtataaataccaacttctctcacctctctggtgggataactctgtgaggtgtgctttatgtcatgtcagagtttctctgcaggattgcctgctatattcactgcttgaatagaaaattcttttttttttttcctttgagacagagtctcactctgtcccccaggctggagtccagtggcacaatctcgggtcactgcaacctctgcctcccaggttcaagcaattcttgggcctcagtctaccgagtagctgggactacagacatgcactaccatgcccacctattttttgtatttttagtagagacacggattcaccatgttggccagactggtcttgaactcctggcctcaagtaatctgcctgcctctgcctcccaaagtgcattgcagctgtgggccaccgcgcctggccaaatgttctttactggacgccttcaatccccttgtcatttcctcattttctttctggcctgcacttcttaaactagttacactgtaatacttgttttagagtctgcttctgtgattaacgtttctgatcagtaaaatggcatagcactgcttacctcaagagatggccgtattttgtcagagaaagaatgtacttcacgttttgcctaataaagtaaacgttcaggacccagcagttgcattttaaatgatcccagtgtttgccctgtttttgaagtacacatgtgcttctgggaaaactcaaactaagacacaccccacacccaactggcaaacacatgccctgttgaaagagtctgcagaagagtccttgcttcaggtacatttttcacattccagtcccagtttagccctcccccatcaccttaatgaccaccattgcataacaagcaatgccttcttgtgaggcattagaggtgactaggagtgagctttagggtgggtacccttcagggggtttctttttttttttttttccttgactaggagtctggctctgttgcccaggctggagtgcagtggcgtgatctcagctcagtgcaacctctactcacgggttcaagcaattttcctgcctcagcctcccgagtagctgggattataggcacttgccaccatgcccagctaatttttgtatttttagtagagacatggtttcaccatgttggccaggctgatctcaaactcctgacttcaagtgatctgcccaccttggtcttccaaagagctgggattacagatgttagccaccgctcccagccccagccttcatattgtttatcttgatttcttttttcttctctgttgtagtggatagcaccagacaatcagtagttgaagcccttttcacatcttcactgggcattctattaaatgacatatgtgttctccccaaactctaacatctgttcattgaaaatagggcaaacaccaagaccatttgtaatacaattgctgactattgaatatttactttgttagaaaaaatgctaagtactttacaatatttctctgcaataaaactcatcttttgagctaacaatgctattctcattctactaaggagaaactttagtcacagagagattaaataatttgctcaacaacacacaaggaagtaagagtctgggagagaatttgtacttttcccttccttttagatgtcattcataaaaaaaaaaaattagtgtacctgattttgtactcctagccactatttaatcctgcctctgtaattagcttttatggataagtttatctttccgtactcagaaaataaaatagtaaaataaaaaggcagcacaaggtgtcactaagtggctttcaccagaggtgaagttgtacagaattagagaggggttttaaccacatctagagcactgcccatagaggaatgcagaccaatttctgaagtcaatttgtgttatcccctgctccttaacctgggttccaataccagttacatttaaggaactctccttccccctctttccagacatttccatggtagaaacacagtagtagttcaggagttaggagacctgggctttagagctttttataaaatgggatgtctgaatttgatagtgtgcaatgttccttccaactccaaacagatgttgtcattttcacagcctctagaagccacaggtaccttctcaattagaagttctaaatgatttgtaatagtgagcactatttggattcctgacagcctatatcaggaaaataagcaaagttttggatcaagtgcttatatctaaagccattgctttataagctggtcttcactgccaattccttcttccctatagattgttggtatttctggtctggatgggttacaagaatttattttattgatttcctgaatctctgtacatccttaaaataattcagaattggaaagaaatacatttagctctttgtcacatagtgtagagatcttttgacataaagagagagctgctgatattctgtttcccctaatgcctgagtgtggcatggtttcaaagggttgctttatcacatgtagacatggagggaccatcaggtaatgagatataacatttcctggaaattaattagtggtgtgttgtccaggaactaaatttcttttactcctgtttgccacctgtcctggatgtctagtgccgaatttgaatttccatgccaaactgaaaaagcagcattggctttagttgccctctttttcacattaacttagggttttagcatgtaaagcgactgcgttgttttagtggaatgaacttagaatgaacttcaacagtgatgaactgataaccaattaaataaataattgattcatctgagaacagtctgactcctagaagtggtgttcctaagaagcttttgtgtaactgccctctggaaagcctcacaagttgttgcctttctttctttattttttccaaatggacaatttttgacaaacaaacttctaagagcagtcaagtgtcaaatacaaagttatggctggtgcagctgcctttgggatcacacgctccatttattcattatagaaagctcagatgcacaaacatgtggtgccattttgtgtacctgtcagtttagtgcgtttaatgaacattgatcatgctcatccagacacacttctcgatgctgcaagcaggaagtcagtggtttctgaaagacagggtgaaaacttgttttttttttttttttcaaatgtgcctctgtggaatcctttttgcccaaaatagatgcattaataaacatgactaaaatgtaccttaaattcactacaaaagagaaaagatgttgatgaaaaatttgctctggttttgctaatattaagtccagtatttgtctacttaaagtagaagttttgatgacttggataatcattagattgctatctagctatttgtagttttgtagcatcatctgttccaaaactgattttttgctctcttttaataccctgttaattacaaaacctcctactgggtagttttaccatacataaattctgtcaagtactgctgaattaattggtgccgaacatcgttccggtctatggtgggagtaatagttcttattttcttgccttttaatgtttggacacaggaaaaggaatatcacacaccagggcctgctgtggggtggagggagggggttttttttgattaggcaacatacctaatgtaaatgacgagttaatgggtgtagcacaccaacatggctgtcaaaattcctttcaaaattctcataaaagaggtagtttagcttctttttttaaattgtattatactttgagttctagggtacatgtgcacaacgtgcagggttgttacatacgtatacatctgccatgttggtgtgctacacccattaactcgtcatttacattaggtatgtttcctaatgctatccctcccccctccctccaccctacagcaggccctggtgtgtgatgttccttttcctgtgtccaactgttctcactgttcaattcccacctatgagtgagaacatgtgatgtttgtttttttgtccttgtgatagtttgctgacaatgatggtttccagcttcatccatgttcctacaaaggacatgaactcatccttttttatggccgcatagtattccatggtatatatgtgccacattttcttaagccagtctatcattgatggagatttgggttggttccaagtctttgctattgtgaacagtgccgcactaaacatatgtgtgcatgtatctttatagcagcatgatttataatcctttgggtatatacccagtaatgggatgactggatcaaatggtatttctagttctagatccttgaggaatggccacactgtcttccacaatggttgagctagtttacagtcccaccaacagtgtaaaagtgttcctatttctccacatcctctccagtacctgttgtttcctgactctttaatgatcgccattctaactggtgtgagatggcgtctcattgcggttttgatttgcatttctctgatggccagtgatggtgagcattttttcatgtgtctgttggctgcataaatgtctttcttcttttgagaagtgtctgttcatatcctttgcccacttgttgatggggttgtttgacttattcttgtaaatttgttagagttctttgtagattctggatattacccatttgtcagatgggtagattgcaaaaattttctcccattctgtaggttgcctgttcactctgatggtagtttcttttgctgtgcagaagctctttggtttaattagatctcatttgtccattttggcttttgttgccatttcttttggtattttagacatgaagtgcttgcccattcctatgtcctgaatcgtattgcctaggttttcttctagggttcttatggttttagatctaacatttaagtctttaatccatcttgaattaatttttgtataaggtgtaaggaagggatccagtttcagctttcaacatatggctagccagttttcccagcaccatttattaaatagggaatcctttccctatttcttgtttttgtcaggtttgtcaaagatcagatggttgtagatgtgtggtgttatttctgagggctctgttctgttccattggtcttcatctctgttttggtaccagtaccatgctgttttggttactgtagccttgtagtatagtttgaagtcaggtagcgtgatgcctccagctttgttcttttggtttaggattgtcttggcaatgtgggctcttttttggttccatatgaactttaaagtagttttttccaagtctgtgaagaaagtcattggtagcttgatggggatggcattgaatctataaattaccttgggcagtatggccattttcacgatattgactcttcctatccatgagcatggaatgttcttccatttctgtcctcttttatttcattgagcagtgctttgtagttctccttgaagagctccttcacaacccttgtgagttggattcctaggtattttattctctttgaagcaattgtgaatgggagttcactcatgatttggctctctgtttgtctcttattggtgtataagaatgctagtgatttttgcacattgattttgtatcctgagactttgctgaagttgcttatcagcttagggagattttgggctgagacaatgggattttctaaatatacaatcatgtcttctgcaagcaggggcaatttgacttcctcttttcctaattgaatgccctttatttccttctcctgcctgattgccctggccagaacttccaacactatgttgaataggagtggtgagagagggcatccctgtcttgtgccagtttgcaaacgaaatggttccagtttttgcccattcagtatgatgttagctgtgggtttgtcataaatagctcttattattttgagatacgtcccatcaatacctaatttgttgagagtttttagcatgaacggctgttgaattttgttgaagtccttttctgcatctattgagataatcatgtggtttttgtccttgtttctttttatgtgatggattacgtttattgattttcgttatgttgaagcagccttgcatcccagggatgaaacccacttgatcatggtggataagctttttgatgtgctgctggattcggtttgccagtattttaatgagtatttttgcatcgatgtttatcatggatattggtctgaaattctcttttttttgttgtgtctctgccaagctttggtatcaggatgatgctggcctcataaaatgagttagggaggattccttctttttctattgattggaatagtttcagaaggaatggtaccagcccctctttgtacctctggtagaattcagctgtgaatctgtctggtcctggactttttttggttggtaggctcttaattattgcctcaatttcagtggctgttattggtctattcagggattcaacttcttcctggtttagtcttcggagggtgtatgtgtccagaaatttatccatttcttctagattttctagtttatttgaatagaagtgtttgtagtattctctgatggtagttaatatttctgtgggatcattaatgatatcccctttatctttttttattacgtctatttgattcttctctcttttcttctttattagtcttgctagcggtctatcacttctgttgatcttttcaaaaaaccagctcctggattcattgatttttttgaagggttttttgtgtctctatctccttcagttctactctgatcttagttatttcttgccttctgctagcttttgaatgtgttttctcttgcttctctagttcttttaattgtgatgttagggtgtcaattttagatctttcctgctttctcttgtgggcatttagtgctataaatttccctctacacactgctttaaatgggtgccagagattctggtatgttgtgtctttgttctcattggtttcaaagaacatctttatttctgccttcatttcgttatgtacccagtagtcattcaggagcaggttgctcagtttccatgtagttgagcagttttgagtgagtttcttaatcctgagttctagtttgattgcactgtggtctgagagacagtttgttatacttcctgttcttttacatttgctgaggagttctttacttccaactttgtggtcaattttggaataagtgtgatgtggtgctgagaagaatgtatattctgttgatttggggtggagagttctgtagatgtctattaggtccgcttggtgcagagccgagttcaattcctggatatccttgttaattttctgcctcatggatctgtctaatattgacagtggggtgttaaagtctcccattattattgtgtggatgtctaagtctctttgtaggtctttaaggacttgctttatgaatctgggtgctcctgtattgggtgcacatatatttaggatagttagctcttcttgttgaattgatccctttaccatatgtaatggccttctttgtcgcttctgatctttgttggtttaaagtctgttttatcagagactaagattgcaacccctgcctttttttgttttccatttgcttggcagatcttcctccatccctttattttgagcctatgtgtgtctcttcacgtgagatgggtgtcctaaatacagcacactgacaggtcttgactctttatccaatttgccagtctgtgtcttttaattggagcatttagcccatttacatttaaggttaatattgttatgtgtgaatttgatcctgtcattatgatgttagctggttattttgctgagtagttgatgcagtttcttcctagcctcgatggtctttacaatttggcatgtttttgcagtggctggtaccggttgttgctttccatgtttagtgctttcttcaggagctcttgtaaggcaggcctggtggtgagaaaatctctcagcatttgcttgtctgtaaaggattttatttctccttcacttatgaagcttagtttggctggatatgaaattctggattgaaaattctttgctttaagaatgttgaatattggcccccaactctcttctggcttgtagagtttctgccgagagatcagctgttagtctgatgggcttctcttagcgggtaacccaacctttctctctggctgcccttaacattttttccttcatttcaactttggtgaatctgacaattatgagtcttggagttgctcttctcgaggagtatctttgttgcattctctgtatttcctgaatttgaatgttggcttgccttgctagttggggaagttctcccagataatatcctgcagagtggttttccaacttggttccattctccccgtcactttcaggtacaccaatcagacgtggatttggtcttttcacatagtcccatattccttggaggctttgttcgtttctttttactcttttttctctaaacttctcttcttgcttcatttcattcatctgatcttcagttactgataccctgtcttccagttgatcgaatcggctactgaagcttatgcatgcatcaggtagtactcgtgccatggttttcagctccatcaggtcatttaaggacttctctgcgctgttgattctagttagccattcatctaatcttttttcaaggtttttagcttctttgtgatgggttcggacatccttcttttgctcagagaggtttgttattaccgatcgtctgaagccttcttctctcaacttgtcaaagtaattctccatccaggtttgttccattgctggcgaggagctgcattcctttgaaggcaaagaggccctctgatttttagaattttcaggttttctgctctgctttctccccatctttgtggttttatctacctttggtctttgatgatggtgacctacagatgggattttgttgtggatgtcctttctgtttgttagttttccttcaaacagtcaggaccctcagctgcaggtctgttggagtttgctggaggtccactccagaccctgtttgcctgagtgtcagcagcagaggctgcggaacagcaaatactgcagaacagcaaatgttgctgcctgatcgttcctctggaagcttcgtctcagatgggcacccggccatatgaggtgtcagtcggcccctactgggaggtgcctcccagttaggctacttggaggtcagggacccacttgaggcggcagtctgtccgttctcagatctcaaactccgtgctgggagaaccactactctcttcaaagctgtcagacagggacgtttaagtctgcagtagtttctgctgccttttgttcagctgtgccatgccccgaagagttggagtctacagaggcaggcaggcctccttgagctgcagtgggctccacccagtttgagcttccttgctgctttgtttacctactcaagcctcagcaatggtgggtgcccctcccccagccttgctgccaccttgcagttccatctcagactgctgtgctaacaataagtgaggctccgtgggcatgggaccctccaagccacgcgcgggatataattttgctaaaaccattggaaaagtgcagtattaggatgggagtcacccaattttccaggtgccatctgtcacggcttcccttggtgaggaaagggaattcccggaccccttgcgcttcccgggtgaggtgatgcctcgctctgcttcagctcatggtccatgggctgcacctactgtcctgtacccgctgtccgacaatccccagtgagatgaacctggtacctcagttagaaatgcagaaattggccgggctcagtggctcacacctgtaatcccagcactttgggaggccgaggcgggtggatcacgaggtcaggagattgagaccatcctggctaacacggtgaaaccccatcaccctaaaaatacaaaaaattagccgggcgtggtggcgggcgcctgtagtcccagctacttgggaggctgaggcaggagaatggcatgaacctgggaggcggagcttgcagtgagccaagattgggccactgcactccagcctgggtgacagagcaagactcttgtctcaaaaaaaaaaaaaaaaaaaggaaatgcagaaatcacctgtcttctgcattgcttacactgggagctgtaggctggagctgttcctagtcggccatcttagaacctcccctagtttagcttattataattagaaggtgccattttttaataaattttttgtttgctgtgtcagtttttattgggagcaaattaccaaaaaaaaaaaaaaaaaaaaattctgtgttcaattagtttaccccagctagaggtgcattatatttagcaatgatttacttataactgttgtgtgggagaatatcctaatcagtttttggaaaaggctaagtatacctatattattctacatgtgttgttattttagcatttatatttcttttgattgagattttgtttcatcaccctggggcacaagatagctcaagaagacagatgtgctcaaattatgcaacagacttatctaaacagctcatgggtcttccaagttcctgatgaaaattagaattgaatcataatgctaagtgtctcacatatccaccctttagacttgatcatcttgtgaaataaatggagcattgcatccagtatgtggtacacttcaagaaaaaaaaatattcacctagcctttttgtggtctaagactctatcatttaaaaactttaaacaagtatataatgaagtgtattcagagatattcattgtagctttgtttgtaatatgaaaaaatcatgaataatctaatattctatcagtagaggaaaggttctaaaaggtatgggccgcacctgtactagaatattataaccccattaaaaataagataggccagtatattctgttatgaagagatgtgtgtgtccgtgagaaaagcagcatatagaacaatatgcatattgtgattattttcatttcataaatgcattgaaaaaatgtacttcttttttatatgtacgtgtatgtaggtaaatgcaaagaataagttttgaagcaaaattatcttcctttatggaggagaatgggatagggcacattgaaaaggtgcttttgatacaaacatctccacttttcagttttgcaaaagtgatgcattagactgaattttgtctaattgtgtgtaattgactttttttaaagaagaaattccgtggaatagataagaggaaccataattaatccaatcaactcagagggactgaacacgtgttatgtgtcagtcactatgcttgccgctgaggacacagtagagagcaaagaaacatgctggccctgacctcagggatatagaaactataggaaattgtataagtgtgcaaatttattattatgtaggaaaagtacaggaaattagaaaatcttacagttttctggtcagtgaagttttcctgaggaaggaatttttgcaccaacaactggagcctgaatcaaggttaactatacaaggaggttatttatgaagtcaaaacaattgaaacactaaagagagagttgggtgaataaacatatagagtatacctgagttaagtggaaattttaagaaataggccagattatctcatctatcttattgaattcaactaatctgtaatgccctgcaaatcgcaaaccatccaaaaagatgggtcactgtaactctcactgcacaaacaatgagccaggtaatattgaagccagaatatttttgtttcttcatttttgatttacttacgtagaagtggcccaagtgagtttcaactcaccatcacccacattatttgagtaactaaacatctgccattgcccaagccatacccaaatatcacctgaactaactctccctttctcccttccatcactgtgcttatgcattcatgtgtccaataaaatatttatggaacgttttgtatatgctagatgttggggaaagcaaacatggtccttactctataaatgtgtattctgttggaagaaacagacaaaaattaatagtcacaaaaagtgattaatgttatgaattaaatgattgaggtgccaagatagagaataaagaagagggcttattttagttgtttttttcagtgaaggtctctgaggaagtagcactgagctgagacttcagcattagaaagagccagatatgacagcatttctccccctttttaaagccaaatagtattccaccctgtgtgtgtgtgtatgtgtgtgtgtgcgtgtgtgtatgtgtgtatatatatgtgtgtgtatgtatgtgtatatatatgtgtgtgtatatatatgtgtgtgtatgtatatatataccacattttctttatccatttatgtgataatggacaccaagattgctttcatattttagctcttgtgaataatgctgctgcagtgaacgtggtagtgcagatatgtctggcacactaactgcttttttttttttttgatacggtctcactctgtcacctaggctggagtgcagtggtgagctcttggttcactgcagcatccacagctcaggcttgagtgatctcacctcagcttcccaagtagctggattacaggtgcacaccaccacacccagctcatttgtttttttgtttgtttgtttgtttgtttagttaagatggggttttgccgtgttgctcaagttggtctggaactcctgggctcaagcaatccacccacctcagccacataaagtgctggattataggcatgagccacagtgcccagcaaaacacactaatttcaattactttggacatatacccagaagtgaaattattagaatcatatagtaattctatttttagttttctaaggaactgccatactgttttctgtattggcttactaatctacattcccatgaatagtgcacaatggtttccctttctccacacctttgccaacacttcctttgtctcttccataattgttctaacagatatcaggtgatagctcattgtggttttaatttgtgtttccctgattatcggtgatgatgagcatgtttgcataaacctattggccatttgtatgtctactttagagaagtgtctatttaggtggctcatttttttattaggttatttgtgggtttttttgctgttgagtttcatatatattttggatattagccctttattagatgtatggcttacaaatattttcccccaatctgtggttgtctctttattagttgtttctttggctgtacagaagctttttagtttgatgcagtcccatttctttatttttggttttgttgcctgcgcttttggggtcatatctaagaaatctttgcccagaccaatgttgcggagcatttcctgtatgttttcttctagtagttttgtagttttcggtgttatattcaagtctttaatccattttgagttgatctaggtttacgatgtgaggtaagtttccaatttcattctacttgcgagtgtcttgccagttgccacaacatggatgaacttggaggacattatgccaattgaaataagccaggcgcagaaggacaaataccatatgatttgacttgcatgtggaattttacaaagttgaactcatagaagtagagagtgatggttaccagaggctgggggagggattggatagggaaaggggaaatgttgatcaaagggtgcaaagtttaatttagacaggaggaataagctttggtgatctattgcacaaagtgatgactataataaataataatgcattacatacttcaaaattgctgagtaaattttaaatgttttgccataaaaaattaaaagtatgtgaagtgatgaatttgttcattagcctgatttaatcatttcatattgtaaacatatttgataacttcacattgtaccccacaaacatgtataattattagttgtcagttacaaataaaatttaaaagaattgaacaaataaaatgtaaaaatatatctgtttaaaaacaaaaaagaaagaaagactctacaagaagagtaaagggaagggcatgtgcaaaagtcttgagctaggaaagaatttgggacattcagccactgaaacaaggagaatgtaaatggagaagcatagcttcagttgaacaaagattgtagtcccagattggtgcagcatctgaggggaaaacaatgaaggcacagcccttattgagacagtgaaagattagagtttgttttgtaatttccggggctggcactgtttttcttggaatcattgaatcttaggtgtggaagactctaaaaggtgatgtaattaggtcattttctctgttgcaggcactttatattggaggtgtgagtagctaaagttctctatgactacaatttttttccacaccttggagccgtttttgtgacagactcaaagacctatcatccatttcttccacgaaggcaatattgaatatatttggagcatcactcctgcctcttcctatatgctgttaattcatgtcgccagcgtcctaaatgaaagtcttcttcatatccaaagaatcttggcaataggaagcatttaaagtcgtcattattttaagtgaagctctcttaaactctgagacagaggagaataattctcttataccacaagaagggctttttcaaatggtcccccatgaaatctatttctgtgtctttccaaaatatgtgaagcagagagttgagccaattatctaaatcatttaagtcaaagagcttaatactaaagtgaatatcctgaattattcccatgattgtgtgtattattaaacaccattaattctaccaattaattaccaattcataaacttctaaaaaacttaaatataaatacagtcatccctcagtgtctgcgaggaattgcttccaggacctcccttatataccaacatccatggatgctcaagtcccttatataaaatggcatagtatttggacataaccaatgcacattctcctgtataccttaaatcacctctggattacttataatacctaatacagtgtaattctatgtaaatagttgttgtaccatttagggaataatgatgagggggaaatgtctgtacatgttcagtacagacacaaccatccaactttttccaaatatttttgatctgcagttggttattagggagaggccaactgtataagctgtatacaatctgtaatagtgaccctggcagcctgtttcagcaaggcttctcagttgacctgcagaacacaggaaattattttagttactcatcttcttagttctcccaaaaaatgctaatgctgttctgttagtattttaggtgcataagagaagcagataatctattacatacaagggatgttcctctatttagaaagcccacttaagaaaggctggtaggttatttaaaaataaaacctagacataaatacatgcctacatgcaatctgtacaaattctacagaaatcattttatatctatttactcttattttcttcccacagaacgtggagcactactatgatttctattcccttgtaattaatttctggttgtcgacttaaactgtgcctttattggcaaagtaaagtgttaaggcaattgaagagacaatgcaggtcaaaaaactgtttatatctctattagaggcaaaagctagacccttagtaaatgtctgttgagtgaagttgaattgaattagtttgagttgaattgaattgaattgctttgagagagcagtagctggagccaattatgactttatcctttggccagtattttcagctgaatgtttcaacaattattcattcaaccaacatttttattgagtgcatacctattatgagccaggcaaaaatgtggttcagggttgtagattcaaagattaaataaacaaggtccctagcttattattactcaagatgtacaaaggaagataatgccatccatgtgtaaaagtaaagagttgtaggcatctctcacaagcataagtaaatgagacaggaaaggcagtgagtgctataggagaaggcattctgaaggactcagcaactgattagagtctcaaggtatgaccttcctaatcagatgaggaaggacgtataattgccatttagtaggcaagagataatgttagtattttctcttaggtgttttttaagcttttaattattttattgaatctttctggaatcactctcttttggcctttggtgttgtggatgtggaaatagggtgttagaaaggaatcctttgtgattttaatgtttggttgggatgttaactgcaaattatgccatcaactctgacagctattttatatatattcattctcactacagtttttaatctctgatctgcagtttaatgtctcttatatcttttattttaagcaacttcatatatttccttcaaatatatatgaaatatatgtatatattttcttcaaatatatatgaaatatatgtatatattttcttcaaatatatatgaaatatatgtatatattttataaatagatatggaggtaaattggtagattgaaaataaaatatatgtattaagttgagaatataccttagaactatactttccttcttttgggaattggctagttgatttttctgatcggtttttttctttagagtatagaatggtggacttggagtttataggtccttagataaaatgtttactttgtgtatagattgcttgagacagattgtgttaagtgtttcttcatcttgaactttttttctgctttctacccatttttatgccagtggatcctgttcattgccaaagtgctcagacacatttaagaactgtatattcctcagtctcaattctagcgagtaaagggaagactctaataattaagtctgtttagttgacactttcataggtttttccctctcttggaatgctttagaagaaaagtttttataaagaaacctactccattagtgtcccttaaaatactgtataataaaataatatctattaagagactcagttatcttaattttcttcttgccatgtgatgaatgacagatttttactgccgtaaatgtgcattttatgtaaagccctttatattgtgaaatttaaaacatataatttcaaataatcaaaccccatatttctaaattcctatattttattccagaaaactagctacttaaaagcaattgaaaaaagaaaaaccctagcataagttctaaaaattttaacatgcaaaagtatcctttctatattgattaaaagatagatatacaaactcactctcaaccattctgatggaaaaaccctggcctgggctctgaagccattttttaaatggaaatcatgaatgattatgattcaggtggcttctagtacacactttgaaaaactctgaagcgtgaagcgtaatcgccaatatctttgaagattcatgacatttatattggcaaggaggaaaggggcacatggtgagctgagggagagttcgtgtagatgtctgggggtaatggcttgcctactttaccagttaaggcatacatcttgaaaataaatcagcattcaatggggtctttgcagtctttgatgtctcagtattaatagatccattcccagcatcaaaattggtactgcattatattttaagcctatgaggggatgccctgcctccagccagagtggttttgcctaccttaccttctaattttttaattccacttcttttcacttatgtttctattgacctccgcaaggtcatagactttctactctttcttaacagtttgttccctttcgccctttatttctttcaccagttctttaaaagcgttcagcattgtagaattttcaggatattcctttattttaaaactgtgttatttggctgggcacggttgctcacgctagtaatcccagccctttgggaggccgaggcaggcggatcacctgaggtgtcaggagatgaagaccaggctggccaacgtggtgaaaccccatctctactgaaaatacaaaaattagccaggcatggcggtgcgtgcctgtaatcccagctacttgggtggctgaggcagaagaattgcttgaacccgggaagtggaggttgcagtgagccaggatcaagccactttactccagcccaggtgaaagagtgagactctgtctcaaaacaacccccccaaaaaaaacctgttttgtttattcatttacttatttgtttgtttactttgtagcaggcccaaacaatgtcttttactcacacttcctattcagaattgtttgccaagataagaaataacaggcagaaagtcatgactcagtacagttaatgatattccaaaagatgctcagctcacatatggtggtggatctcccactggcttggcaggtgcggtaatagcaggctaaagaatgtggaccacggtctggagtctggttctcaagtgggcaatgagttttaaacaggatatgaagccatttctgattgactgatctgattaacatctgcagcagtgtttctccaggtatgattcacagagacgataaagatatactgtatcttcaattctactttttagagagaaaggggccactagctggatgaacactgggacagcaagtgcaaactaggatagtccaggctagactgtggccatggtcaccctgcttctcaactaccatacctagaatcatgggaaatgtttgttaaaattggagatccttaaggattactttaagatgtctgaaattcaaatgggaatctgcagtgcttcctgtttctgggaaattaaaacaaagataacttttatattagagcattaggacattagatgtttcaaagtgtgggctcctgaccaacaaatccacaccacctgataacttgtaagaaatgcagatccctaggcctcaccccagacctactgaactagaagctgggatggggccaggatatctgttttaagactttccaatttattattttgatgcatactgaagtttgagaaccattgttctgttggatctggcaaaccagtgtctttttactttattttatttttttttacttggtatcataataatatgatttttaaaaatctggatgttcttcccactagcatttcctcatgtcagtgatgatcgaattttaaccatcattgaaagaactatagagagatagctataaggagatatgaagatatgaatgttccaccttagcttgaattgtggtcatctgaagtatctgtgttcctctctctttctgtctctgtatgtgtgtgtgtgcgcgcgtgcttgtgtgtgtgtctgtatctgattctaaaatggaggaagaagacaagtctagtggcttggatagctaagggaaaggagtgaaaggaattatggagaagagaagagcaataaaacagagacaaacattgaagcagttgtcttcttagagggcctggttgtgatcctccatttccagtgcccgaggcattcagctctgcagtgaacaccaagatggtcaagttcaccagatctttagctcaacactctgaccattttaaaagcagtgccttttgaaaaaaaatctttgggagtaaattttttagttttagccttaggagtgtcaaaactagtgctagcaaaagcctctggcaataagtaaatgagattaacaaagccaagggaactgcacagaagtgttacaaacctgaagagcagttttctttttcttccataaatattatatttgtaaagatatgcttggcattcagtcatttgtccactgtccagatcactttttttaaaaaattattattatactttaagttttagggtacatgtgcacaacgtgcaggttagttacatatgtataccatgaaactggaaatcatcattctcagtaaactatcgcaaggacaaaaaaaccagatcactttttagtttcataccggcaaaggtacgagctgatggattaagtcacactgacctcagatccattaactgacacaacttgaaaatccctcatatgtctttaaattccaaatgtatgaatgaaattttgtgttgtcatttgtcattgtgtgtctttgtttagatatgaccttaatacatattgtgagcagataatttgtgaattgctcataattctcaagagttccagttcctctcttcacttttaatatgtgcgtgttgtgctaaagcttccaactgatgtcgtgtgagtgtatttgagaatagagacatgtgtttgtctttgaatgatggggtatctatacgttgcaaagctaaacattctgaattttttaatttactcatccattcaacagatgtatatattcacacatatacgtatatatatgtatatacacacgtatgtatatacacacatatttgtgtatgaatgaatatatgtgtgaatatatatacacacatatttgtacatatatattcatacatatataacaaatatattcatacatatataactatatatattttatatatacatatatacatatatctaacatatatgtatatatgtatatatatatacatgtatataacaaaaatatatacatatataaaaagattatatatgtgtttatattttcacacacatatatatttctatatacatatgtgtgtatatgtatatgtgtgtatatatatataaaggttaaatgagtattccatggccctgtatttgattaatggttaattcaggattggaattgatgcattatggtgaggtatatctactgtacattttgggcaccattcacttatatggtcatcagttcatttataaagtgtcactaaagacaaaatgagttgctgcattttaccttcagtaattacaaaataaaagaagtgaaaacatttggaaaaatccgagggagctcctaagaactccattattgggatgagtggactatgatatgcagtaataagcacatgtattaatatgtgattcaaaagtaacattttctatgaaggacaggtatcttatttaagcctcctgcctgtatgatctgattgaatcagcattgcttaccataggacccaagagaaataaaactatatttcccaatattatctgtccccgaaagagactcttgttcatggagaaatattctaacaaagctgaagataaagtataacctttgggggcctcttcttcaacatattctattctgcagagtagcaggtaataaataaggtattagggtagcttttcagttcaaatttaattttgattcctgcagtggattcgactgtggcattcaaacatagatttgcaggtgcagagagagagtgttacttagccctgcagtgtgactaattgctggtaattgtctataggaagggcgttagaaaggcctgtctccagattttcatcatattttacccaaggacactggcaacgtgaggaggcagtctggagcactgtagccattaagctgttggcagtgtgcagtatacaaaatgttggatctaagtttaaagacaagcctgtgtaaaatgaatttttatataaatagaaaactgtgaaaatgtaatcattgaaaaaatgctgtattttcatttctgattaaccttcatttgaaattggctcttagcaacatatacttccttctcatgtcttgcttttttcctctttccagtaactaatattctataactagtatttaatatgctggttagaaaaccaccaggggatttaactggatatgaaacaaaattgatttataatgaaaatatgtgttgaagtaagctttataaaatgggaatttagtatatccttaagtcagatatttctgtaaccttgtgaaaaagcacagttcctatgtcattttggtcacattgtttttctttcctttccctcctgtttctattatgcttttgttaaatcgaggaaggaattcaagtaattagcattttacaattgtctggaactgccaaaaaaatacctaacaaaaaatacacattattatgggaactgtaaagatttaagcagatataactcaagagataaaatgagttattccaaagtgtgaaatgaagaaagtccagatcttggcaaatgagaaaattatcttgctatctgcaaagcattctactaaattttaagatttttttttaatagaatcagaactgcaaggcttgtttgtctttatttattttatcctatgttccttaaatattgaactattgtaatcttgtcgttaacccccatccctaacacacacacattttttttttaattgggagttttgtggatttgtctaaaaaaggaaacactgtgatttaggattttggtaatattcagcataatgattagttttattctattatgtggaccttaagctacttgggtagtttaaatagtgatagatccactagtactatttctttgacagataagatccagaggcttacttctaaatgtgaatcctaaattaccaaacatttttgaaatggttaatgagagtgcatctgtttctttattccaagtttaattttcaactggatatctgcactttgtctctgaagaagtatttcctagaggaggaaaaagccttttgatcctttttaataatttacttatgagaagtaatttacataaaatagtagcttatttatgaaaaatagggagggtgtaaggagggagaggagaagaaaaggtaactattggttactgggcttaatatctgggttatgaagtaatgtatacaacaaacgcccatgacgtgtgtttacctgtgtaacaaaccttcacatgtacctcgaaacctcaaataaaagttaaaaaaaaaaaaaaagaagaaaagtaacttagaattcagagggataagttttaaaggaagccctgtggaagccttgcaggaaaaagttttctttgacaaacctgtcctttcaacataattgatgagttggttccagcctggttccttgtgacccatccagcactgagtaggaaatgacacagaaaatgaatgttgtggtctcatttgtcagccagggccactagtttcttgcaggatacctgaattttcttctgtgcttttctcacatgtgcccatccctccttttctttcagtgcctttctctccctttaaccaccagggcgactgcccttttattagtttcttagcgttagttctaaagagtctgatggcctcttgtaacgtacatattgagcttccatagcaaagaatacaaatcatcacaaatcacaatagtccaataagaaagaatattgatctttccaaagtaatttcagtcatatatgactgagctcaattttaaatatgtatttcagtgtcgacttacccaacacactgaacctgcttctctgatctggtattagacttgtactctgcctacagaccagtgcctaggttagttcatccataaagggaccaaaagcagtgaccactcctcctggggtgaagttcagtgtttctttttttcccatttacttagttaagcagtcagttttaactttactatccagctgattttgtgtataaatggattcatttgtagtttatcttgtttttgctaggctgtgggctaggaaggaccaaatggatttacgtagtttatcggataaaccaattttgagtatcattttgtcaggaaaccctttttaacctcttcctggatagccccagccaccttaatttacactcctctgggagcatttatctttccttcatggcaatgtaattttgtatatatttacatgttctttttaaggcttttcattcagtcttttttgaacaactactttataccaagtcccgttacttcaatgaatataaatggataaaaatctctgccttatgaagcttgtattctagtaaaaaaaaaaaaaaaaagcagaagttaataacatgtaatagaacatcaggtaatgaaaagtgctatgaagataaaacgaggcagagtagaaatagagaatcacctaggagaagaggcagtggcgacattaggtatgctgttccggagagtcctctctgaggaagggatgcagagccaggaactaaatacaaggagatgcttgtcctgggaagatgggcgagaactcttcaggcagaaggggcagccttcttggaagctcatttaccgtattcgagaaagagaaaggcaaccagtgacgctaagagtggtgaatgagggaaagtggcagaaatggcgagtgtagaggctgacagggatcagatcacatagagccttgttgggtgacataagaaattcatatttttttctaatttaagtggaagatcaaagtaggattttaaattgtagctcacctgttagaccatgcctgccatatgaggacagagtctgccattaccactgcagcctagtactgaataaatattggctggctggctggctggctggctggctggtcagacagatgaactaatgtccttccaaccctgttgcttttacttatgtggttttattaaaaacaaagcattttgttggtttgctttgttgctatcagagttacacatattgttattggtattgcatttgtaccccttgacaaaaggaagtttactatttattatcactagataattagaatttcctacctcacatgcctgaaatgccgcatccccccaccccacttcttactatgtaaaaaaaaaaaaaatctatctctctatctatctatctatctatctgattggctcgacagcttgaacgtgattgagtgtccatttaagcctacttgtattttcatctgattactaatcctgaaggataatgttaagccagattctgcagcacagaggtcagaggatcagacatcagctctcctaaaatgatgggatgggatagaaagaatgatgataacccgattaatctccctttagggggactctggagtcaggagatgtgtttgtggccttggtaacagccttcctgctggttagaggaggacctgcatattcttgggattcctctctcataatgggtcacaccacatccaggtattaccacctgggagaagaaaggtgacagctatttttaattctttgataaatctcgaagatagaggtggaaccaaggatgtcatggaacatcatgcaagtgttaactaagtagtcctctttgaaaatatttagatctatagactatcttgccgcttgaaaaacattttatattgctaagtaggaactgtcttcttaattttcttataattctctttgcttgaattatccctaaaaattaaccatagattttcaaataagctcaaagaaaacatggatgttaatgctagattcatcatgtaataattattattatattaatagtaattcacctttgcattttttcatgtcttagtatttaacttctgtttcatgatcctgttcatcctaaagttagcacctttttcttgccatgtatttgccaggcgacatatttgatcggagcttccagaacccatctctctccaccacatcctcttttactgacactccgggatgctgctaatatcaatttgaggttttgcagagatgggggaagcctacattgtctgcatgttctgcccttgtctaggttgtatgattcttgagggtagtgactacatcctattcttttttctgtttcctgtagcacctagcagaaactctactgtatagaaggtattcagctagctgttcaatgactagatggacagatgaatgagtgaatattttatttcctgttctgattttggtaggattcttaagtccataattccctaatctgcccactttgctcagagatacaaatttcaaaattccccttaaccttggagagaccctagggaagggcagcattagcttaagcagtgggagacattttttcagtgtaggatcttttttcctgtgtgttttaacctcttagagagaacgtgggttctttattcctgctgtggcacggtcctgtttttattagcgtacccaactagactgcagcacatatgttacaatgagccatgccacatgcaaagataaacaaatgtgatgttaatgagatttgagtgtagaatctgtttttctcttctatagcctccagagttttagagaattttgtcactgtcccatttaactggcatctttcttaaagggctggctttattcataccaattattttctcattctctccctgattcctttcactcaaattcagtaaactctcatcttccagtacattatcctgcagctcatttataccttcaccctcactccttgaaatgaattcagaatctgatttggagcttgtctctctaagtgtaaaacacctcctgctataaataaacacactcggtttacttaggtttgatacttagatgagttgcatcagcatatgttctacttcacgttatcagcgtcttctgagttgaattctcatcatttttttgccttaaaaatgacagtgctaaatatgtcctgagggactaaggcaggttgagaaaacctctctgcagtattggagaaagccaagttaaatccagcctgctagcctaatgtaaacaatataatcgttcttcccttatttactttatttgtgaggatcatatactagtaaactggggtagagtagatgagcaaaaaataactaggggaagaacaacatgaacggcaaagttgcttatgcaacaaaagacatgtcatattttatctttcaatttaagaaaaaattatgggagtttcatatgcttgacactatcattattcctctactaactgccttctattataatgagtcttctttttttctcccagtcaacacattacatatacctctatttaacatttatttcttgattagttgttcataggtgtatcttttcccagtaccccacctccctccatacaaggagcctaagcatattgccatgaatgtaacagattccaagtacatgcctgttgtgttgaaacattgctcaccaatcacaaattttggcacattctaattatctaatgtctttaagagttagtgttgtaataaagacttaataattatttgtctatcaatcattaagttgatatcagtgtaccaggaatagtaactcctcaaaaaaagccagtgtttatgattaacttctaacatttaaatatgctatgtctatatttataatatattttatgtgcttgtttattctctgtatccactattataatgttcataagagcaatttctttttctacgtagcaagacctgtaagaatataggagagatactgtatttatatatgtatgtatatattcaataaatttattcaaaaatatgtgttgagtacagatatatgtacatattctgaatgaatatattaaaaatgtatataccttatatgttcatatactcagtatgaatattcaatacattatacatatctatactcaatacatatttttgagtgaattaattgagtacttcttatgtgttgggttctgttaataagtacttcaaatgcattatctctttcaatccctcaagattccagttaagtgtagatactattattatcctaattttaaggatgaggaaatgtaggtttggcattggtaagtggttttctgaaagatattcaattcataaaaaagatagaatcaagccttaggtccaggcctgtctaacacaaaagcaaatgcccttagctactgtgatatacttctcctacagtaattaactgagagaaaattttgtgtgaaaatatggaaataattgtgcctggtgggatcatggacactaacaggataagatcatcaaatagtcctgtggtcccctatgatgaggtgagcgtagccaagcccagagcaggcagcgaagcctggtgggggaaaagctgtggggcacgcaagagaaagaggtcacaagcctggggcagagaatgtagtgtccagttggaagcatcatgaatcagaatctgggtgatctgtgattctggaactagagtgttgccttaaaagcaagtatattcacctctcaagaagaaaaaagcaaatgagaataaagatggaatggaagatctatcaagtcattgggacactattctcgactgttggagtgatagggagttgtgtgcagtgattgggcttctcaaatgcaagtggtgaaaactcaactcaaatgaacttgagaattgtcctctttctccccaggatctaaattgaacactcgaaagctatcggaaggttggtcgagggcatgaagtagtactctgccaaggcttttttattaacagctcccttttctgcatattcccatggagccagaggaagtgattctctgaatggatatattctgctagtaacatatcgtggcagctgtatccgttatccatttaacaattattactgagtacaggacaatatagagaatatgttacttcctctgttaactctgccctggttgtccagcagcccaggtgtcctcacctgttaactgagagtgagcaagtctaatttgtgtttggtaggcagattaagtaaaaatgtataggaaagcatcgtgtgaatgatgaggtaccatatcaatatgaggtactattttatcatcagtaccaagccatgtaaggctacctttctatctccagaggcttttactttaaatctccaacctagcccatgtaacttttttttattattacactaatttccacttccataaaaaaggtcacagttttcagagagtgcatattacttatataactgtttaatcaaaggatcatgctaagatataaggaaaacctagaatctttatacattttcccaagctagggtgatgtttggagcatgttggatttaaaagacagaaaaataatagagaaaagctttgctattttcgagatcattatttgaaagatagtttcatcaaccactgataggtaagtcatctattaatgggcatttgggttgttttcagctattgactattgtgaataatactgcaataaacttaagaatgcagacagatagggctgggcgtggtgactcacacctgtaatcccagcactttgggaggctgaggtgggtgcgtcacctgaagtcaggagttcgataccagcctggccaacatggcaaaaccccgtctctactaaaaatacaaaaattagccgggcgtggtgatgcacccctgttatcccagctactagggaggttgaggcaagtgaactgcttgaacccaggaggcggaggttgcagtgatctgagatcatgccactgcactccagcctgggtgacagagcaagactccatctcaaaaaaaaaaaaaaaaaaaatgcagactgctagctctttgagatcctgatttcaattcttttggacatatatccagaagtggtattgctggatcaaatggtagcttttaaaaatgtggtatatttatgcaatggaatatcgttctgtcttaaaaaataatgaaatcttgctatttatgacaacatggatgaacttggaggacattatgctaagtaaaataagccagacacaggagtccaaatactatatgatttcacttatttgtgttatctaaaatagttacactcacagaagcagggaatgggatgcagttgctagagaatggagggaggaggaaatgggaattgttgttcaatgggtatagactgtcagtcaggcaagatgaaaaaattccacagatctgttgtacaacatagtgcttatagttaacagtactgtattgtcactttattttttgttaagagggtagaagctgggtgtggtggcttacacctataatcccagcactttggaaggccaagatgggtggatcacttgagcccaggaatttgagaccctcctggcaatatgacaaaaatccaatctctacaaaaaatacagaaattagctggtcatgctggcacatacctgtagtcccagctacttgggaggctgaggcaggaggatcacttgagcctgggaggtcaaggctgcagtgagctgagatcacaccactgcactccagcctgggtgaaggagtgagactctgtctcaaaataaataaataaataaataaataaataaaataaaaaagatgccagtcaggtgtgtgtataggagctaggagatagaagagatgtgtttgtatgttttcttgtttaaagatttttgaaggctatgatgattctcaatattgcactttgcaatggtagtttggtgacaggtttagcatagctatttggcagtgggattccttggaggtgtaaaggttttatcagtgtcactttgtctcctgtccaggtttttaccggttaaaaaaaaagaactaaggagccaaatgccactcaaggttttattaatagagactgaataactcccaatacaggctccttgctaaaatgcaactagtgaatttggcttggaccaaagcccccactttgaattaagataacttgtccccaagaagagtcaacctgactcaaccaaacaagttacaggcaaataaattggaataaagaaagaaaatacctggctgggcctgaaaaggcagaccctgtcctctctgcttaccataggcaggcaagaaccaagctgagctcaccactcacattgttaaaggaaaagatcacagcagatattacagagaccttcctttccctagggaacaagtgaggaagggtgaaggggggccaagagtggtattaactttgccccctgaggtgggaagactactcaattacttttctatgacctaaaagaagaatgtagagatagaagggaaggtatttggttttctccttcatgattaatcaattttatttatgagaatagagaagaaatattcctaagtaaggaagtaagagtgaccttgaaactaggtatattattatccagatatggttatagtctgaatttaatttttattaatgtaataatagcttacatgggccttatggcgacattactagcactctaaaatttaattagatttttagagcttctattaatgtcttttgtaggattatacaatctggggcatcaccagcaagcttcatacattttattttcattatgatttgaaatgagaggaatatggtattttgtgaattaaaatagtttagactggggaggtcttaaaaaaaaaaaaagaaaagacaaccccagagggttgaaatcagttttttttgtactaaactggttatatgtatttttatatagatcttaaatatatttattcaccaatattaaggaattaccagttttttatttttatcaaatttttaataaatattagttgactgtaaccatataaatgtagttatcctcacgatagtttaaaaataatcattttcatgcaacatattttctttagtgtgtatatttcttgagttttttgcgctgatgaagtaagtattccattttcatggtcccttcattattgtatcctgattatatatgtaatatgccttcccaggttcagtaaatcctttaaattaatagaaaaatctgttcagccttgttgagagtcactgcatcaatgtactggttacttttgtaaattttaacccatttatctctttccctcacattccaaaaacaagaactcagggcacacattaaatctctattttacataaagcgtgctcttgaaaaggagatagatactatagattcttagtgacattctttgagttttcaccattcaaactcttaatttagagtagcctgcaaatcaggtacatgcctaggtgacattcacagagaatggaaaagaataaccctatccagaattgacataaagtgttagcattgtatacagagcaggaaaaatgggaacaggaatcagaagctcatttatagactctgctatctactgctatttgatccagaaaagtcattttacttgccctggcctgagttttcttctctgcaaaattaggccgttgggaaggaaggtctctgcatcccatctgagccccagcaatatataaagttgattactgcaggagcaccaagtgttagttgctttgtgcatgcatcatgcgaattcaccgaggctttgtgcagccatgctctgctgcagtagttctgtccttacatgccttctggtggctttagagagagattctatttgggaagggacttagtctggcatgattagagcctagtaattacaaaagtgccaagtgatcctcatctataattacagtgctagtttgttactcattgtccccgaggccataacattaggtggaggagggcatgcgcacggttcctgaaacttaaatgcatccatacttttagtgctgtattttttgctgaattggtatttatctttaatgaatgccaggcttctaccctttcggaatcaatcacttctgtttatgagttggaaaaagacagggaccagagcatgtaggagtatatgagagacagtgtcttattactcagcttatttcctaatcctcgtatgaagataagatcataaaaaatacaaaacaatgtcagggaaagggaatatcaaagcccagcttgttaaagagtcatgaccccagagaagcctagacccctcttctccatgaactctaaaaaatcacctttttttgtgtttttgttgtaatactggccttcattattgcaaatcttcctggttgtactttacaatgattttaattttgtttcctgattagatctttgcaattattcgtaatgttcatctgagtgaaataaaatgatatacactgaagcagtgttaacagattgtaagatttgatatgttttgaaaagaaatggtaatgataaatgacagtgacctaatttgtggaacaatcttcttgtacaaaataatctagtggttggtaattatgtgattaactcaccaagaaaaaaaaaagtcaatcaagtcagaatcatcaagttatagaatcaaaaaaaatgtctggaatgttcccagttaattcattacctacagtgaacttttcatgtgaatgccaaaacataaatactattttaaaaacatttaggggaaagatgtacatttattaaccctaaaactcaaaagacaatcaagaaggaaaaacagcgaaaatctcgaaaagcagtaatgatagctgcttgttgttagtacttatgaggcactttcaccaacataaaacctcatctcaaaataaatgagtgaaggagtaaggcacaatataaccaagtccattttcaacatgaggaacttgaggctcagtgggattcaatgccgtgttcatgatcatgtagcttttcagaggcacggcttcaaaatttgttacctacttcatgctcttttaactatgtgctgttaagaaaataaaagtgaaatatctatgggatatcaattctgaaaaaatattagcacatttgattaggaactgcatcattgagaattcagttaagactttatttataatgcacaaaagcaatagatatgtataacttgaaggtcagtgttataaacatagcccaaactacaagtcaacagagtgaattatagtttggttaatatgcaaaatcattaagatggtttgacttgaaaccagcaaatcatatgaaactgtatttataaaactacaattacaatttagaagttattttgaaaagaaaatcacactttcatgatgggaatatgaaaaatattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaacggctgaatacctgaatgtgtgaatatttttaaaaactttttcgatcacatttatcctggagtgagatgaaaatatagctgttgcatttaagaatgtaagtagtgggtgagtaatttagagatatcataataagcgttttggaagtagagctaaaagataaaagagtctttgattataaataactaaaaggagcagccaaatcactaaataccaggcatacttcatctgttagtggccttagggacaaaaataaaaccagtaaatatggtgtggaagcaactaatcatcgctggattgctcaagagaggatatgtgtgagacccacataaaggtagggatggacttatgagttcttccagtaaagggctgccattgaacacagcaagggctgtggcagacagatatgcaggaagcaataggcaaatttaatatcagtaaggaagaatcatcaagctgtgtttggcttaataataaccattattcttcatttggggttattgattgttctgaaggctacgacaagtgtaatgaactgttaccaccactttgggtgaatgttggccctcaaatgatcattatccagagaggacaatataaataaagtgctgaaagtacagcaaaaagaagagagttagaaaagggagaaagtgggtcttgcttccttccctagtcttttttcttttttttaaggggagacacctttgcttctatactttacttcccattaccggaaatctcttcagcgatccgttttaactgccctggtagtggatcagaagaaggaggacatttttactgttaaggttttactgttttgtcagtgatggaggaagggcgcctccaaaaaatatgcaaagttaaattcagtgtttcaataaattgtttgtttagccagacgtgtctgagtttcttgcctcttcgggtagtcattcctgaagtgtgtcttattgagcagagataacattattgtgtagtccctgaaagagaattggaaccaagttttgggggaaagcttttgtgcacaggtcagcaaagttaactgttgtattagtggagactaaacctggacactagatattcaaaacttgcctctcttctctctgtcagttctctcaaaatcagggttaatattcaaatatattaaattcaaattgaatttgttcctagtaagcacttactatgtgggaatattttgctaggcacagtagattatttaatccatactgtagacaggtcacataggcatttataatctctgttgtactatcatgaattgaggtgaagagagattgggtcacctgctatctgcacagctaagagcaggtagagctgggaactgagttcaagccttcctgaatctgaatctcatgatcttttaccatacaaacttgcctgaatgtgaattgactggccttatgagggagtaatttccccatcactgtgataagagtagcagtcttcctcctcctctcccttcttttcctactcctaataaagcaacacctgcctctattattatgaatgttatctcaaattgtatatatttatttctattgagttgaaattcacataacatagaactagccattttaaaataaacaattcagtggcatttagtacgcttacaccgatgtgcagccatcatctctattagtcctaaaatattttcatcaccttcaaataaaaccccattcccgttaaggagttactcagcattcctcttcctcactccacttccaaccctagcaaacaccaatctgctttccgtctctttggatttacctattctggatatttcgtataaatagaaccatacaatatgtaaccttctgtgtctagcttttttcatttagcatgatatgtctgagactcatccacatcgtagcacctgtcagtatttccttcttttttatgtacaaataatattccactgtgtatatataccgcattttgtttatccattcgtctatctatggacgcttgagttgtttccaccttttggctattgtgaaaagtgctgctgtgaacattcatacacaagtatttgcttgaggaactgttttccattctttgggagctacatctgtttttggcatttactttgtgctagtcaatgaactgagtgctttgtaccaggaactctttagattctcagaaccctatgaggtgaatactattattatctctgttttacgaatgaggaaatggattcacagagaggttaaagtacctcatattgggtcacgctgagattaaacccaatgagccaggttcctgagtctgtactctatactctttctttcttttgttgcgtcagcttcagacttgacacctagagctgcttctgctgttccctccccaataccaagcttgcctgcttttcccgggcatactttcaattgttgtgtttcctcttaaaattcagaatccaatgttgcatacaatattccaaaagtaatttttataattattaccatcattgccattgttgatattttgataacatttgaaaggcactttgatgtttttcaaaacaatatgtattagttttcttccttaataatgaaaattatataacaaacaacaaaaaacaagccccaagcttcatagcacagagtatgcctgttggcattaaaaaataaagtcacggtatatatacagggttaaaaatccaaacagtaaagaaatatgtaaaatgtttattaggatttttttctggaaaagtaaattatgaatattcccaaatgcttgttccagatgtgttctgacaatggttgggcgcagattcccatttatgtcctcaatcagctcattttaagctcattcagcaggtgtataacaaaccaggggagactaaaactcccaggtccttttctcgtgatctgctactgagtcatagcccctgtctgccatattgggcttatgcagttgattttctcaacctaaatgcagaaatttccatgtccctgtgtaattcattaagcatgttttagcccaatgcccttctcaaggtacgtttacatcccaagtgtgagatcctgtctgttaactgtctttctcagttgagaaagcacagataactctgccacttggccatgctgagggctcatgaattacattattagtagaaatgagattttgaccacctcaggattcacttagaagcgtgttggaaagattcctgctcagaccaaacatctcccaccttccattttcagagtaatgtgttccgtctgtggaaccacagcttcatttgcatggaagtgatagggagccattctctacagcattgcaaactatggagactgtatacaagtctcagttgcagtactgaattgcacactctcctgctcagtataatttattagctggagatgtgcctacattaatagtatttgaccacattttaatttaactgtgctacaatgaattaaaccaaatagtaaagttacaatgtatgagtccatttttataccattagaagttaatattaacctataaagtgaattgtgtttaaaaaatgaacgatgttttatctaaccctgacatacatatctttcttgtgtataacagtcctatagggtaagttgagctaagcttttacttgtatctttttaaataaactatctttgttagaatggaaatctctaatgatcagatatgtataattgagttttcatatcttcattaagtttaaagatattaattaagcattatctatctatttattccctcttatgagatgttgatagagatcatttgggagcggacaatacttgttaaaactatgtgcagttttctaatgagcctttcaagaatgtgcgatttttttttccccacgaagttagtacccatgaattttgtgatttcttttcttaaggataaagacaagccaaatggttgtcttgcttttttaaggttgttttatataactagagattcttcttggcttcctttttaaatggattttttgataggaagaaaatgcaaatgaagtaacagtggagctcataaatttctagcctggtgactataatgcagggtattggctttgctatcaaacttccccaagcacatttgctttgtattagtgacttatgcaatattggatctttcgtctgtacattagactgtacaattcttcctttccgcctagcatgctttgcattccactctttagacagatgtgtgtgaatgtagcattctttctcagctgaagctaacaagtgtcagcatcagatttcccctatatattccaaatctgataaaaggataccctgtggttatgaaaattatagacacttaatacctaaggcaagtggcttgcagtctcagcagattcctaaatgatgatctgccccatggtgatgcaaaagtgatgttaacactttcctaggaagatcttcaatggggaatgttcctttggcaatttgaatgcatcactatacttttccagccttttttcttcacctcacctaattttatgagttgtatgcatatctaaaataaaatgtgcatttagaattggccacatgtggacacatgccatgatatctcagaagacagtaaaaacgaacttgaaaaccagaaaaatgcacaggtcatatagggatcacttataattgcccctgcttttcccatggcattttcagtcccatcattattccatctacagcgcatctccaaagcaaaatatattatgaaaaagtcatgtatggtatttcaaattaaacaataacattttctaggtgcagagcaactctcgtgatatggccagttagacttttcatcttggtcttgccctttagatatactttgtgatgctggtggccaggtggcaagcagagaaggaggggcattctagaggcggtactaaagacagctcaaagctctagaaagtgtttaagtcttttattagaccactatggctgcaacaaaaggctaacctggttcctgtcctttctagctaaataagcccaaccaatgtgtccacagggcaaccagtgatataagaggatgatctgatttttatggtattacttccatttctgagccaagcatagcaaatatatagtttaactgttgtcagtcttcttcccttgtatttatggaagttatcattaattttatattgtagtcttttctgctaaacccaggcattgcttcataatctttcacaagatagcgcatgagagagctattgctgctgggtcagagttgttacatgagttgcatcttatctggccatctatctctgggctgagttacggtcacatttccctctgatagatctctaatatagcaggtgtagagttaaaggtctttcactttttctgggaggtcaccctgacaatagaagaacctggatttcttatcctatgtatagtttatcaccacggttgctcggcatgctcttttctggtatccctagctcaaccctaactttggtcatcattgtttttcaggttttcaatcaccttaaagttgccactgttccaaaagtcatttggtgagccattctgactgtttccactttgagaatctcgtgccaggtcactagagataaatatgcttattctggaactcccagacattaatctcagggtcaattcatggttctgtgaatgcttgataccaccatcagcactgtgaggcctggaactttgccatgactgctacctcctttgggctcaaatattaaggagataggggcagatactgggcctttgattaatatttctcctctgacgtacatgacccctttatcctcttcacttccttgatgttcctgggtgttgacatagatgaagatgatggttttccctatcttaagtgaaaaacaattcatgtttcgctttgggtagactgaatggcctttaaggattacagttgaagatagttttatccaaaaggtctcaacgcaaatcttttcttatagattagtctattaaatgtgaggggcatctctaccagagattctggcagggatggcaactttggttttaaatttgttagtcaataaatatttgagtaactactgtgtgtgtggtgccatgataatcactggaaatagtagcagtagctgaaagagtgagagttctcatgtagcttccagttatggaagacgataagctaagctgagaattctgctcctttatggccccttactaggaaataaattcgtgtgatctaggaagcccctgtccttctgggtgatgagtggaattcatctacacagtcttaccagtcttacaaatgtctgtcctaaaagactagtaacccaccttacccatattccaaggaaccttgaggcccatatttattatacatggccattatttgtatccatgattatataaacacagatgaattggtcatttcccctgtctgtgttctctactcttaaataacttagttctcctcccttgtacagatatgtgtatttttaaatctagaaatgttagtagttatagaaaaagctactaactgttttcactcttcttcccttttatttatggaagttatcattaattattaattattaattaattagttaacattaattaatgagataatctacattatctcagtgaattttcacactaaccctgtggagttatggttttaatatccaggtattatggtttcagaaaacaaagttatgcaagctcagtgatctctcccaggctggccagctactaagcggtagatccagggctcccacccacgtggtctgattctagaacctgagctcttaaccgctgtaccgacttgtatcactagccaacatctgggctgctctctgctttatcaatgagtaaactgaagcccaggctcttaagtgacttgtcaagttaacagactattcagcaacagatttgaattttcgtattaatatagtgtaaataacaacagttaaatcatttatagtgcttattatatgccagccactcttctaagtgctttttatattggctcatttacttaataactactggttattgtccccatttcacttagaggcaaactgatgctttctgagaccaagttgcttagggtcacacagctgccaagctaagcagctaagattctaactcagcctgtctagtgccagactttgtgttcggatttggtgattctcaaagagaagaagctttcttctcccactccaggagcatgtgcaatgcctggagacatttttggttatcacaactttgggggaggggagacctttatataatctagtggacagaggccaggtatgctgctgaccatcctcaagtacacaagatagacccttacaataaataattatttgtcctcaagtgtcaacagtgttataaccacctttctatggttataacacaccatcagtggcatccagcaaaagatttccaaatcaggaaagcagagagtagcctccagtgtccatgcttagtttagtgtgtcttttatcatgactgcaattctgggctggaatgttactgtttagtatgtacctcataaggataaagactagcattgtgcccagcaagagccaatgggggctcattaattattacaatggaagcacaaattggtgtgtttagatataggatgaaagaatgggaactcagttggagaaaatcataaaagtagcactctgatgactagtggtgatgattttggcttcagtaaagagaagtggccacattgttattcaaaaacatgatattttggataggaagaaagctgatgtttcaggcgttttctttttgtttaaacaaacctattttgcagattttgtatgccttttatcagtcatgcagctcaattacagtctgggcagcaagtttggacaaaaataaaaagaggaataaaaatatttttatacctacattgtatatttctcacaagagtttccaagtataattatccatgaatttcatccaaaaatcttcaactgtgtgaatcttacatttggttacttactggctaatcaggattgggcctaaatccagtgtatacattacataaagaggtgaggacagataatccaagcaaaagaaatttccttataaaattcctaaaatagtatcatttcagtatgggaccgatataaaaattattaatgggatattttacattttttctttgctgtctttgaacttggtatgtatttcacacttccagcacatctcattttggaaaagctataacaatgtttctgagacttaccatatttgagaaccatttccttagtctgtgcttttaaggaatgaagttgttggacgcggtgtctttttacctttatttgttgtcatagatgatgatgactaaaagtgtcttgtccaaatacaaatgtgaaaaggctgaagaccaagatataaatgaaatagaaggctgttatctactaaatgggctttttaaaaaaaaaaaacacttgactttaagactactaataaaactgtaaaataagagcatacttttgaaataagaacacatcaaacaaagtaaaactaaagtttagctcctttgtgtcccaggctgaaataaaagcatgtgggaggacctaccaatttatattatcaaagttaaatggacacaggtcatctttagcatacaggataaggttttagcatgaggaacactttatataaaaatatactgttttttggttcatgtgaaagatattattggccaggtgcggtggcccacgcctgtaatcccagcactttgggaggctgaggcggatggatcacctgaggtcaggagttcgagaccagcctgggcaacatggtgaaaccccatctctactaaaatacaaaaatcagctgggtgtggtggcgagcacctataatcccagctacttgggaagctgaggcaggagaattggttgaaccttggggatgaaggttgcagtgagccaagatcgtgcgaattcactccagcctgtgcaacagagcaaaactccgtctcaaaaaaaataaataaaataaaaataaggaaacgtattattaaaataggaatgacttactttttgtctcaccctgcttctttgtgtctggtactacggtatgatatgtcatgcatcttactagaggaagatgctgcctttatatgtgaagtggattcttatgacctagaaccagaacaagtgtgttaggcttcattttccaagcctcataatgaaatgccttgaagtattcattttcctgtccaatcttctttaaaaacaatatttgcacccctaaccgtaggcagtaattttgtacttctcagaccattgcaccaagtttgatttctacatgaagtttactattgtttgtgtatatggaatggcttatgacaacttcatttgtcctctgctctatctatcctaggtactagaatacctagggtcctagcagtccaatatgcctggattatgccaaacataacacactactggagatatgtatttgatgaacattccgtattcttttttggccagcttggcaagcaggagaatccgcagttagctcttcctttgaccagttatttctaagtgttgttgcaggaagtggcgcattaggaactagtctttttggtttgttgtgcaactagcacttgtgtaactccctctacctgaaccattgcctctcccatcagccagggtagcttaaaggaatgttgaggaaataaaaagtaggcataaaggtattgtgcatagtagtggggatatagatggggaaacagagggaggaagaggagtgactaaagagaaagctacatgtagtcaagtgttgtttatcagactctggtgtggatcacaatcgcctggggacgaattaaaatgatacattattgggattttacattcttcccaaagaggctttgatttactgggtttcaggttggaacaaaatgcattttatcaaggactacagttgagacactctgctgtagaggaaaggcaaactctgccctagaggaaaatgaggtatcctaaattccattttctggttcttcttcaaggcagaaggccaggactgaggttattttgtggcaaccacatttattgaatctccttccctggcatgtagctcatctggaaatgactttcctgtggaggctttgataaccttataggctcttaatttggattctggaacaggttgggataagaagaaaaatttctttcttgtgtttctagaaatgtataaactatatactaagcacagagtttctgttgggaatgatgaaaaaggtctgaagatggatggtggtgatggttgcacagcagtgtgaatgtacttatgccactgtattgtacatttgaaaagtaaatggtatttatgtatattttactgctatattatatattctatgtatactacaataataactttattaactcactacaacttttgagattattttagtaatctgtgggcatgattcctgatgaggacttcagtgaggcagacaaccatgaagactaactaactgttcatcaatttagaaaaaataagtttttgcagttgatttctctcttttaaaacttttaaatttcagcaaagatctgaaaaatgtgagtgatgccttcttcggtctcttaaaaaataaaaataatgtccgggcgtggtggctcacgcctgtaatcccagcactttgggaggccgagatagacggattgcctgagctcaggagttcgtgaccagcctgggcaacacggtgaaaccccgtctctcctaaaatataaaaaattaaccgggtgtggcagcgtgcgcctgtagtcccagctactcaggaggctgaggcaggagaattgcttgaacccgggaggcagaggttgcagtgagccgagattgcgccacttcactccagcctaggcgacacagcgagactccatctcaaaaaaataaaaaattcaaataaaaaaataaaataaaaataattaggatagcaaagcaggtgttcaacttgaaacctctctgtgttttcttgaagcttgaaacctctcagtttctgccttggatcagatgatatctttgttggtccttttctgacatgaggtgctataggtctacagtttactgagataatttacataacattttgatatggaatattttacctaaaatggagtgtgcaattcataattggaaggtatagggaggagtgtttaattgacttgatgcattcatgtgtcatgctcaaggtcaaaagcctcaagtatgtgagtactttgtaactggctgtctgtcaaagataccagggaattcaatctattacatgcacttcactgcactaaaccaacactacatgaagccatcagaacataggatggcctcactaatctcgctgcaataattactgcaggtgtctcctgatcatttaaaacaggcatttatattaggatgcattattctgttcaaatattagggccattagaattttaagagaatttcactttgaatatttgatacaaaagatgaaatgcttgtcaaactaatatatcctgcacgttctcagcccctaaacctaagactgttttcttggtacgaaagtatgcatatgtgaaacaaaacgtaagtgtttgtcgctgctcttaacttgtatctttcaccaacatctacaggagttgtgtagaataataagattagaacccttcaaagctttaaaaaccaaatctgggatttcaaaataaaagaaattttcatgggagagaggggagggcagtaattttgtaaagtacatttttaaaaggactggaatgattcattctttcagcgtgtgattgtgagtttgctggtgtggcagaaagactcttgttgctatggtatccctggacaatgttttgggcattggctgtcatagctgtaactggtcattttaagggggtgtcatacatgcattttgactattgttttcatgatgaagctggattgttttgatatatattctatttcaaattaaattatttaatacaaaaccctcttaaaaatgagcataataagtgaacaaaatagctcttttatggtaatggtaattttttaataacaggaagtgttaactattttcattccaactgttatttaatcattgtagaaagtagagaaagtagagggtcctttgttcttttagcaagaccttaatcttcatttcttcgttaaattagtttttttctttctttctttctttctttctttttttttttttttttgcatttccagctgccaaagtgctgtcactgatctaattttagtattcacacatatggagtagatgccagtcttgccttatttaaaaaaagtcttccagtatcgctaatacatatttttcccattggatgatatgcaaaattatgggtttttttttttttttttgagaagagaaatcctggtcaggacctggcttcccaaaatacccaagggtatgaatattgatgagattcctaaattggtgcacttttgctaatacatttactttctgaattctaaatttagtttctagctagagtccccattagtcctttctatagtttggcctctcagtgcaaggactgggaaactgtaaatgttaattatatttgcccttggacagttattaactctacttcccaactatcttcaacatattttttggtaagtcacagcaaaattgagttacatgtgtgaaatgcatcttaacataatagcaagagaatggttttcattgtagaatagacatgagcctgtatctcagcctttctccttatgtttgtatgacaattgggaatttatttaatgtctctgagccactgttccctcaaatgcgaatagtaatatctgccttgtgatgattacataaaacaatatatgtaaaggtccaggtagaatgccctataaacagtagttatgcactaattaataacttattattatcagtaattaattaattaaaaatctcttagatataggtgtaaattacaacagaagataataatcttttaaaatcaagaccaaatgtgacagagacagacctgaacttggccttgcagtgtcctggtccctcctgagtgcagagactattcctgctaatgcgaattccacctttcttttgccattcatgcagcattcacacatcacctcatacttttcaaaagagtttgatgaagtgggtatctttatctatattttatagccgacaaacctgaagcccaaagagaacttcgtcattctataagtggggacaaagttatacccagacccaggctctcctgattcctagtttagtgatattttactcgaccatgctgctcctagtgaattgagtcccttctttgttaagaaaccagagcacaaagagtcctattcataagactgaatttgacatttaaatttttggacatttttggcattttaattttcttattaaatgtaattaaccaaaatagaaaaactaagaataaagaaataacaaacaattttaatgcaagatggtcccctctgaagaccatatagggtgttcatggaggattttcaggaatttcctcgagacccatgaaattgcgtgttccatgttgtatgctaccagtgtatttctagggcagtgggcatatcagattttgggtctgtgactgcttctctaaacatataacaagaaaagataccatcaagcatatgagataagcagattgttagaacaagatactaagttgtcattttaagggtatcatatattattacatttcagaaatgcagagtcttacggtaggctgttgtgtctgggatctacagagaagactacatcagtcagaatgtgttaggctgcagaatacctaccttaaataatattttatgctatattactattacagtttttaattggaggcctgtagattaggtagttctaggactatctcagaggttcattcatgtcagcagtgacctaggttaattttttttttctttcttctctatgcttctaagtatcttcgcctttagttctcatgcatctcaaggtatggtctcaaaatgccatcattctatcagaatcacatcagggttgaaagtaaggaaaaatgggggaaagggatgcaccattaggcttctcttattcctgacacttttataaagaagggaaagttttcccagaaatcctcttccatgtaagactttccttgtagctcattggtcattcctagctttaaggtgtcaaagtacataagcatctggcaaggagaaataagattgctataattggcctagtccagtcaaaatccgtcactgtggtcgagctcattgctacttagatgagaagtggtgttctgttgtctcagaaaaaggagaaactggtagttagctaaccactatctctctttactgtgataattttgcacaaaccaagatgaattgactaagtttcgctctttactagattgagaaatacgtttcattcctaaaatatccaaatgtactaagacataaccatttacttaattctttgcctcttaagtatggcaattatttctaatattctacttttaaagttgaagctattcagactaagaaaacagtgagagattcattaagtaagtaacaaagttaaacctgcaactgatcatttgattttctagcaggtgctcattctgtcccatgttaattctaacagaggtcatagctgaacatgatgccttatttcttctttaatctatatacagttttatggactttgagtcttttatagccctaaatttttagaataactcttaaaaggaaaaatgcgccagattttcagatgtaggtttctcatacaattagaggaatattctaacactgggtcaacttaaagcctcattttgggatttatcagaatatgcaatctgctgtttggagggaatggccattttgcaaccagtttttcacctagtttatagaagctagaggtacattgtgtcagtacaaaaacaggccttccattctcttgatccattgtttcatatatatgggtgatgggctcagtataaaaatctaatgtttgaatttctgacatgtgttattagaatctactccctaaggtcttagtgaaaaacgtaaataacttttcactgtctaatttaactcatctgaagtctgcttatgaattttgcaggaggaggcacaagactgtattagtgtttatatgtgagataaaattgttgactaaaaatcttttaaagaaatggttttttacattaatttgctaatataagtatataccatgggactgacattgcttttcaaggttctataacatttctttgatgactaggtatatgttgctttcttttttttttttggagacagggtctcgctctctcgcccaggctggagtgcagtggcagaatctcagctcactgcaacctctgcctcccaggttcaagcgaggttcaagcaattcttctgcctcagcatcctgagtagctgagattacaggcacatgccaccacgcctggctaattttttgtatttttagtagagacggggtttcaccgtgttagcccagtggtctcgatctcctgacctcatgattcacccatgttggcctcccaaagtgctgggattacgggtgtgagccaccgcgcctggccatgttgcttatttttataaaacagggttattggatagttttacgcttctcaacagtgtaatttttctattgataaaattgtacaacttactctttttttgcttccttatcgcatcttgagactcttgtgcattctggagcaaggttgtagatgtatctcttaacttcacatatagtctcatttctgctcctgtcttaatattgtgacctttttcccacagtcttgtctgccaccatgagaggccaacagacacttacacccccacaatgtatttctctctcatattcttttgaaagactctaatagtctctaacccataagaacgaatgttacttcttacccacttgagatagtgataaaattagacctggcctgcctctcgttttaggaatatagcatacttagagttatgcctgtttgcacagcctctgaagctgaactgaggaaagtttaataaatccaatggtcaatcaatagacaactatgtttgagacgtctggtatatgtaaggtttgggactggatgcttcgagagatgaaaaaaggacaaaatacagcctttacccttaagatgctgtcacatttccaagggaaaagatggcacatgttcatgaaaaattaactgttacataagactctgtatacattattggttgaattaattttgttgaatgaatacagctccagtaagaacacctataggaattcataggagggaccaatcattgtgagtcaaagaaactaaaaaaatcacagcacatttgatttggaagaggttatcgagttccccatcacccagatatgtaaagagacttctcaaactaagtcccagagagtgactgtgattttcaaagagctacaagcttttattgacagaaccagtatttatttggagagactgatagacttgatttattcaggaaggaatggagaaaaatcctaggtggaaaagaatatgtttatttgacagatgtatttggaaaaaaataagcatttatctatggaaaggagagagttaaaaaatatggttaagggctagccttctgcttcttgccttttattttccctaaaatgatagcatgttctagaactaatggaataattttttttccttagaagtgagtggcatctgtgttttctctttttaatggggaaaaattattatttcccttccgaaatagttaattcaaggaatagtgcccttttaatcttatgattgtcctccataaatgttaaacttgtaaatcatctggctttgttgaattggaggccatctgtccctccagaggtgcattggttcacagtattccaaaatgaggtgatcatggcatgtgccaacgggaaattaaaaaagctctcctctaaatgttctaagcatcaggttatggtgtcaaaatcatttgccaatgaacttttcattaaccttgcctgaatcttgtattagaatcatgggtcttagcttctgagcacatttataaatgccttattttcgtcaaagctgtatacaatacacattgtaaaacctagataaaatgctcagatgtggcacaaaatgtgatctgagtaattttgacatcaagaatcccatagatgtgaagtatttctcaagctacctagaattgtaaacaagagaaggactcttgagtttaaaaatgttctccccgaaaccccatctctactaaaaatacaaaattagccgggggtggtggtgcacgcctgtaatcccagctactcagaaggctgaggcaggagaattgcaacaagagcgaaattccatctcaaaaaaaaaaaaaaaaaagttctccccagctctccacctgataaatcaaagacaagtgcttttcttttgttgttgttgttgttgtttgttcattcatttgtttttgagacagagtcttgttctgccacccaggctgtagtgcaatggccccatcttggctcactgcaacttccacctcccgggttcaagcgattgtcctccttcagcttcccgagtaactggattacatgcatgcatcactgcacccagctaagttttgtatttttagtagatatgggttttgtcaagttggccaggctggtctcaaatttctggcctcatgtgatccacctgcctcggcgtcccaaagtgctgggattactggcatgagtcactgcacctggcctcaaggacaaattttacttacatggtaagcaagattattttggaaatgatagaatgcaataaaggtgatagataaccttagagaaaaagttgaaaaaggaaagaggcagaggcaatgtagggccttgacaatagaagcaataaataaactagaaatgaatccttaagcaggctccattgcagaagaaatgcaagatttctcccagaaaaacatttgacattagattcctctaattccaacataaggaagaagttgtagagagaaccatagaattttataggtgaactaaaagtataagattgtctatttttattctttcagcttctcctgatttttcttgtaatgtgtgcatgaggggtaggagtgtggtgagtcaataagtgattaaattgaattgaaagactagcatagtcggcagggcgtggtggctcatgcctgtaatcccagtactttgggaggccgaagcaggtggatcacctgaggtcaggagtttgagaccagcctggccaacctggtgaaattccatctctactaaacaaaaaattagctgggcgtggtggtggacacctgtaatcccaggtactcaggaggctgaggcaggagaatcgcttgaacccaaaaggtggaggttgcagtgagccaaaatcgtgccactgtgctccagcctgggcaacaagagcaaaactccatctcaaaaaaaaaaaaaaaaaaaaacacctgccagcattactctcctgctgtactacgatagcatcttcactagtctccctgtctctaactggcttcctcaattccacctggactctacctcactccttgccactttccttcttctctactattccataccttttatactagccattgtaaagttaatttatttgccccaaagcagtgtactccaataatgtagctgctagccacctgtgtctgtttacatttaaattaattaaaatcagataaaattaaaatttcagttcgtaaattatactacccttatttcagattctcaatggccacttgtagctgatggttaacatattgaattgcaccaattttagaacatacctatcaacatgcctgtcattgcagaaagttcagctgggcagtgatgcttcaaagattagtggtctcccttgcattcttctcataagccagaaagttactggggtaacagtatacaacatttgccggccaggcgcggtggctcatgactgtaatcccagcactttgggaggccgaggtgggcggatcacttgaggtctggagttccagagcagcctgaccaatacggagaaaccctgtctctactaaaaatacaaaattagccaggtgtggtggtgcatgcctgtaatctcagctactcgggaggctgaggcaggagaatcacttgaactcgggggaggcgaaggttgtggtgagccaagatcacgccactgcactccagcctgggcgacaaaagcaaaactcggtctcaaaaaaaaaaaaaatattgccaagtcttcctcatttcccttctggtttcatatgctaaggttccttctgggactgtctgccggggtgtcatctcctttttcttgccacctcactagcctgccttaactttgtttagataccctttctatgctgttctttttacatagggcttcccttagcacagcatttcatcacatatatcgtaattgtttggtttttagtctctaccctccaccaaactctaaagcagtatttcttgctcttgctcttgctcacgttcatgcttggggcatgcagcttaatgcctagcacttcttgaacactcaataaacttttgattaattagtgaattacttaaaatgtttattcagaataaacaggcacacctaatagaattaatgcatttataatttatatgaacttaagccttttaaaacatttcgctttcattataaaactagaaattaatttcttcagacattgcccttaagaaaattactctaaggaatgtgtaagttatgtaaaatatatttaaccctaaaccacacaatgatgatgaaggtggtggttgtagtagtaataatgataataggaaatgtaaggaaaaataaggcagtctcacaccctattaagaaggaaacaacatttagaataagcctactttgtgtcaagccatgttagaaacccattatttaatataattagtacaaatcaactgttttcttttttctatgttgcctccaacccttgagtacatgaatgcataattttccacttgaatccatatctcaggtagtttatatttgtagttttagaattaatatttcattgtaggtatccaacatagtataattatttttaatgactgcatgatattctttctgtgaagacagtatcatttacttagaaactctctgattaccttttagacagctaaattgtttttaatctttcatattttaaatagcaatgcattcaatattttcatgtaaacagtttttcttaatgagaaggaggtattttaccttaagctgaattgctttggtttaaaaatatgtgagtttattgaaacattttgccaaatatttcttcatactgttgtaggcattgtcatcattttaaattctttgttaatttgacaggtacgaaatggacaaaaaggattttaaagttgtatctggggtgggaaatatgtctcaaaacacttggagataactgctatcatgttgaggaagaagtccgttcaaagaagaaaaggatgccatttgttttacttagttctttaaactaaagcactaacctcttttacaccaaagttaatatcccctttataaactctgagttcttaggtgttcttactcaagagggtaaggatatgacattagtgtcacatcactctatgtggagtaggatccagtgagcttaggaacccagaagaaacatgtattcacagcttggctttgatagaagcaatagactgattttcatttgctctaagggtgttttacaatatgtttcatttcaaaatgtaacaaatgatagtgcacagatgtttaaatcttcctgtatacattcccttctgccaatctcccatgtcagttcctttttattgatgcttatttttgtttgactgtttaattgccatgatttaagctattggtggttcaggatgcacttgcctgccctatattaacaacagtaatgcaaaaataacaacaataataataatgcctgtttattgagttttctcaaagatgagaaaactgagtcacagatgaagtaacttgtccaaaattgcactgctattcaaacataggcagtctagtctgaatttccagctcttaactcatatgctctacacagtggatcagggttcttttgtttagtatttcaggtagttataggtgaaattctgaaatactgtctgcaaaatgtataaaaggtgttcttgaggactggtttgtagttgtagtttgggaatacttgccaaatgctcacaaaatctgggtttgaaaagcatatggtctgagaagcagtctaaattcactccaaataagtcacaaaaaattaatatccctttttgttcatgactggtgggccagaggactcctttagggtgggactgctggccttcagcaagatatgcagcagcaactttaatggtatccttgtggaaattgtggatgacaatgagtagttcaggtgattttgtgggcttgcactttctgatgaaaccagaggcagagtaggttaagtacatggaagtggagtgagccaatgtcagttaagattttggcgtttccactgcaggatcttgagtacatttttgtttctctaaaagtttcacattcttcctctctgctctagggatgctaatgtgcagcattcaccacctgatagctgtaaacataaaaatggggtcatgtatgtactatgtttgcatggcacatccatacaatgttatactgttcagcaataaaaggaacaaagcactgctacctcttacggcaagagtgaactcagaaacattttgctaagtcaatgaaaccagatgcgttgtatgattccatttatatatgtccaggaaaggccaatatagagagacaggaagtagaatagtagttgcctgggactatagatgtgcgtggaggattgactgcagagggtcctgagggatctccttggggtaatagaaatattctaaaattggattgtgattatgattgtgctattctttaaatattctaaaaactccttgaattatacacttataacaggtgaatttttatactctgtaaagtataccttagcaaacataaaaaaagtagtcaataattgttggtatcattttattttttattattagtctttattgttcatataactgagagattctggggatgtgctataggaccctgtatttgaacttcatcaggattttagctactttttggatgacaacatgctttcacatttgagaatgacacagctggaagggataactaatggcttagaacccctaaccaagattggaattgttttgacagcctaaaaagctggttgaagcccataagatgaaattgaacaaaaataaatgtaaaatctggcacaggctgggttcctcaggcaagcaaaagaggtttaagcagctggcttctaaagtagctcttgttcttataagaaatgtttgtgcctctcagaaagggagtggcagaaaacctgggacaggattcaggccaaaactgaaggctccaactataaatgacatctgaggtttttgttagatgctggaagagttacttagttggacattccatgttttatgttcatatactaataatagtaattattattatatttataatgataaaactccatgcttcccatgacataagctctgtggtaaatgctttatatacattatctcattcaacaattataacaaccttacaaacagaatatttttatcctatttacatatgcagaactgagtcttagtgagcctttagtcaaacagctagtgaatggcagcccagttagaaagcacctagtcaggattgagggcccatattttcaactcttaagctctatcttctacccttagaatttcttattcacagaatatagttcttgaaatctagcaaagtgaaaattcaaaagcaaagaagtacatagtctatgcattttgcggggagaacacagatgattttaccaataccaagattggtttattttcgctctaatcctttgggagggactaatttccatcactgagttctaaactgctacgtctaatgagctgtgcgaaaatgctgaggtattgcaggctgtggccattcaagcaagaaggcagtaagctcagtaggaacagctgcttaataaaaggctattagtaggccagaaaacaaacaggagattttgctgaaacatataatctatttttaaattactttgaaatagtcacttgggcattgatacagaggaggattatcaacagtcggatggtttatagaaaataccttgaaatagacttttagatatttcctattttatcttcaataatctaaggagggggaaagggcagtcaccatgtatttatgaaaaataaaatagatgatgcgttgacttgaaaccttttcattttaaagaaggaaaatgcattctacaaagtcagaaaagtacatttttgatgttttcttatttcagagtgtcgcataatgcatatctttgtctgagatgtgctatagatccaaggatcgagggctagaagtctaccttctggctcttttatagtgtgtatgaataccatagaaatgctctttaattactttttaaaataataaatgaaatatgtgagttccgtgatacatagttgtcttttctttatctgtttgttttttttttttatttccaacttttattttaagttcagaggtacatgtgtgggatgtgtaggtttgttacataggtaaacatgtgccatgatggtttactgcacagatcatctcattacccagatactaagcccggcatcagttagctattcttcctgatcctctccctccgcccacacccgtccctctgacaggctccagtttgtgttgttccccaccatgtgtccctttgttctcatcatttagctcccacttataagtgagaacatgcactatttggttttctgttcctgcgttagtttgctaaggataatggtctccagctccatccatgtccctgcaaaggacatgatctcattcttttttatggctgaatagtattccatggtgtatatataccacattttctttctctagtctgtcactgatggacatttaggttgattccatgtccttgctattgtgaatagtgctgcaatgaacatatttagccctaattatattatatttatactttaatttttactatataatatcttgatcacagctttggcaaaaggctttttttccttttcacaccaatgagagaagcttatcttaactgcatattctcttatttaagctttttccttttcccagcaggactttcatctttgctcattctttccatctttctgtcactttggcacagtctatgactagaaagcatcaaccatttcaataatatttgttttgtttctccctttaaatatcaaaaaacctatataggtttgcttttttaagagaaaaaaataataactttatctgttgttaccatttctatagccttttatctttttgacccaggaaacaagttacttgtaaaccttttttcacttaactaaacaaatgaacatttttaaaatttaaatttagctcctactgtgagaaaaccttttaaatggcttattttcaaggcataagtctaagccctggcagccagcctgcgaatgtaacaaaccacacaactcatgcgccttgaaggtcaccataagtgaacagaatgtagaggaagggtcagcccataaaagggaagaaagtttcgttattgggaaattgaaacttaagcggggaagggaaccagggtataaccttataagggggataatgaaacttacgcgatgcccgggaagattgtaaccccatagtactcaaccagtgaggaactgggggagggacttgcatgctaggagataaattacctgctgtagcttccctgggtgtgcctgtctatcagacaccagatcttgcaatactgccattaaaagtcttgcttccgctgttcttcatggctctgagtccattctttggatttggacgggtgagcgtgtttctcacactaccaaaattagacaaacacattacaagaaaataaaactacaaacagaaatttctcatgaatgtagaagcaaaatcctctacaaaatcttagcaaattgaatcaataatgtataaaaataattatacaccaccaccaccaagtgggattcacatcaggtatccaagggtggttcaacattcaaatatcaattaatgtaattcatcacatcagtaggctaaagaagaaaaattagacagttatatcactagatgcagaaaagcatttgacagattcaacactcattcatgataagaactctctgcaaactaagaatagagaagcgcttcctcaactttgataaagaatatctaaaaaaaaccctacagttaacatcatacttaatggtgagaatctcaaagttttcctaccaggatcagaaacaaagcaaggataacttctaccactgcttttcagcatcatactagatgtttttagctaatgcaacaagacaagaaaaagtaaaagtatacagattggaaaggaagaaattaaactgccttttcttgtagatgacatgactacctatgtagaaaattccagaaaatcaacataaaatctcctggatgtaataaataattgtaaccgagatgcaggatatcattgttaacatagaccagtaaatgactgactttcctgtatatcaacaatgaccaactggaacttgaaaataaaaacataataccatttatgttagcacgccaaaaatgatatactttgatataaatttcacaaaatatgtacgaggtctatgtgaagaaaactagaaaactctgataaaagaactaaataagtggaaatatatttcatgtttatacataggaagactccatattgtgaggaggtcagtttttcccaacttgatctatagattcgatgcagtcccaatcaaaatcccagaaaggtattttgtggatatgtacttattgagtctaaagtttatatgatccaaaatagccaattcagtatggaaggagaagaacaaagtagtcaattgaatgactctactcaacttcaagaaatgctgtatagctacagaaatcaagacagtgtggtattgttgaaagaacagacaaatagatcagaacagagagcccagaaatatatccacatcaatatagttagctaatctttgacaaaggagtaaaggcaataaaatgaagaaaagatagtttttttaattctttctttctttcttttctttttcttttctttctttctttctttctttctttctctctttctctctttctctctttctctctttctttctttctttctctctttctctctttctccctctttctttctctctttctttctttgtttttttgaaacagagtctcgctctgtcacccaggctggagtgcagtggggcgatcttggctcactgcaacctccacctcccaggttcaaatgattttcctacctcagcctcctgagcagctaggattacaggtgcacgccaccatgtccagctaatttttgtatttttagtagagatgtggtttcaccatgtttgccagactgatctcaaacttctgacctcaagtgatccacccgcctcgacctcccaaagtgctgggattacaggtgtgagccactgtgcccagccaagatagtcttttcaataaatggtcctggaacaactgaacatcaacatgtaagacaaaaacaaatcaaaaaaagaatctagtcactgacttaaaccccgcgcaaaaaaattaacccaaaatggatcaaagaccgacatgtaaaatttaaaactgtaaaacctcttgaagataacaaggagaaaatctatgatatggtttggctgtatccctacccaaatctcatcttgaattgtaatcacataatccctatgtgttgtgggggggaccttgtgggaggtaattaaatcatgggggtggttctcctatgctgttctcatgttagtgagttctcaaaagatctgatggttttataagcaactggcatttcccctagagagaatgctagcactcattctctctcctgccgccctgtgaagaggggcctccatgcctcatgccatgattgtaagtttcatgagatctcccctgccatgtggaactgtgagtcaattaaacttcttttctttataaaatactcagtctctgcatagcagtgtgagaacagactaatacagtaaattggtactgcagagagtggggtgctgctataaagatagacgaaaatgtgaaagcgattttgtaagtgggtaacagaggttgaaacagtttggagggctcagaagacaggaagatacgagaaaatttggaacttcctagagacttgttgaatggttttgaccaaaatgctgatagtgatatggacaatgaagtccagtctgaggtcatctcagatggagatgaagaacttcttgggaactggagcagaggtgacttgctatgatttagcaaagagactggcagcattttgcccctgccctagagatctgtggaactttgaactttagagagctgatttagggtacctgacagaagcaatttctaagtaacaaagggttcaagagaaagcagatcataaaagtttggaaaatttgcagcctgatgatgtgatagaaaaaaaaaaaccattttctggggagaaattcaagccagctgcagaaaattccataagtaataaggagctgaatatatcaccatgacaatggggaaactgtccccagggtatgtcacagaccttcaggacaggccctcccatgacaggcccagaggcctagaagggaaatatggtttccttgaatgggcccagggaacccctgctttatgcagcttagggacatggtgccctgcatcccagccactccggccgtggctaaaaggggccaaggtacacacagggcatggcttcagagggtgcaagcctcaagcctaggcagcttccacatggtgttggtcctctgtatacacagaagtcaagaattgaggtttgagaacctccacttagatttcagagggtatatggaaatgcctggatgttcaggcaaaagtttgctgcagggacaaagccctcatggagaacctttgctagggtagtgtgaaagggaaatgtggggttggaggccccacactgagtccccactgtggcactgcctagtggagctatgagaagaaggccaccatcctccagaccccagaatggtagatccacctacagcttgtactgtgcacctggaaaagccacagacactcaatgccagcctgtgaaagcagccaggaggggtgctataccctgcaaagccataggggtagagctgcccaaggctgtgggagcccacctgttgcatcagtttgacctggatgtgagacatgggagttaaaggagatcattttggagctttaaggtttactgactgtcctattacattttagacttgcctggggcctgcagccgctttgttttggccaatgtcttccatttggaatgggcgtatttacccaatatctgtacccccattgtatctaggaagtaactaacttgctttcgattttaccacctcataggcagaagggacttgtcttctctcagatgacattttggacttggatttttgggttaatgctggaatgagctaagactaggggctattggaaaggtatgattgtgttttgaaacaagatttgggaggggtcaggggcagaatgatatggttttgctgtgtttccacccaaacttcatcttgagttgtaatcccataattcccatgtgttgtggaagggaccccttgggaggtaattgattcatgggggccatttccccaatgctgttctcatgatagtgagtgagttctcatgagatctgatggttttataagtggcatttcccctgctggcatgcattttctctcctgccaccctgtgaagaggtgccttctaccatgattgtaagtttcctgaggcctccccaaccatgtggaactgtaagtcaattaaactttttttctttataaaatacccagtctcaggtatttcttcatagcagcgtgagaacagactaatactgtctagatgactttggatttggctatgatattttggatatgacatcaaaggcaagatctatgaaagaaagaattgataggctggacattattaaaattaaaaatattttatctgcaaaaagatactgtcaagagaatgaaaagaacaaccacaaactgggagaaaacattggcaaagacatacctgataaaggactgttagcaaaatctacaaagaactttcttaaaactcaacaatcaggaaacaaacaacaaattttaaaaatctgttacattaacagatattttattgaaaaaaatacacagacagcaaataattatatgaaaagatgctacacaccatatgtcatcagagaaatgaaaataactatgagatactactacatgcttattagaacaataagccaatcttggaacacagacaacctgctaacctgataagacagtaagtccaattctattgctagacaacattgctcaatgtaaaaataactcatggtttgttaattgcatcggcatgaagaggaactgcaaatggcctatgaatactagattgtgatgtgatgctttgggcttccctggcatgcagtgactcttataactgtgtattccatgtgaggaccctggaagcaatttatatggaattgctaaaggaaatactggctcctataggggatgaggcttgtaaaccagggtgacttcagcacaggaccaatgtgactcttgtctccttgtatctgaactgtcacccagaaggctgtgtcaacggctacaaggacatccacagtgaggaactgctgctatcctgctgacatgctgtgctcttgaactgtatttttctgtgtatcctgagcctattgagaggtgacagcgtgctggcagccctcacagcccttgctcgctctccgcacctcctcagcctctgcgcccactctggccatgctcgaggagcccttcagcctgccactgtgctgtgggggcccctctctgggctggccgaggctgagccagctccctctgcttgcgggaaggtgtgcgagaggcacgggcgggagccagggctgcaccctgcgctcaccggccagcgcgagttccaggtggccgtgggctcggcggcccgcactcagagcagcgggctggtgccactggccccgggcagtgagtggcttagcaccctggccagcagctgcagagggtgcgccgggtcccccagcagtgccggccggccagtgctgcgctcgaattcccgccaggcctcagctgcctccccgtggggcagggcttgggacctgcagcctgccatgcagagcctctccccctgtggctgtgggctccagcgcggccggagcctccgcagacagcacctccccctgctccgcggtgcccggtcccatcgactgcccaagggctgaggagggcgggcacgcggtggcacgggactggtggccaactccgcctgtggccccagtgcaggatccactaggtgaagccagctgggctcctgagtctagtggggacttggagaacctttatgtctagctaagggattgtaaatacaccaagcagcactctgtgtctagctcaaggtttgtaaatgcaccaattagcattctgtatctagctgatctggtggggacttggagaatctttttgtctagcttagggattgtaaatacacccatcggcactctgtgtctagttcaaggtttgtaaatgcaccaatcagcactctgtatctaggtaatctgggggggacttggagaatctttgtctagctaagggattgtaaatacaccaatcagcactctctgtctagctcaaggtttgtaaacacaccaatcagcatcctgtgtgtagctcaaggtttgtaaatgcaccaatcagtgctctgtgtctagctaatctagtgggtacttggagaacttttgtgtctagctcagggattataaacgcaccagtcagcaccctgtcaaaacggatcgatcagctctctgtaaaatggaccaatcagcaggaagtgggtggggccagataagggaataaaagcaggctgcctgagccagcagtggcaacccgcgcaggtgcccttccacactgtggaagctttgttctttcgctctttgcaataaatcttgctgctgctcactctttgggtccacactgcctttgagctgtaacattcatctcgaaggtctgcagcttctctcctgaggccagccagaccacgaacccactgggaggaacaacaactccagacaccctaccttaagagctgtaacactcactgcgaaggtctgcagtttcactcctgaagcccgcgagatcaggaacccaccagaaggaagaaactcggaacacagctgaacatcaggagggacaaaccctggacacaccagctttaagaactgtaacactcacccaccgtaagggtccgcggcttcattctggaagtcagtgagaccaagaacccaccaattccagatacactatgatagtcttatgtttagctgaatcaagaggaacttctagaaggtagtaaacatctgactagaacattatgatcaaaatagtgaaatgtttggatttttgaatgattttaatatgatagtgaaaaacagttgttcactaaagaccagataatttaacttgattcttatagaaaaatataatatttattgaagtctactgtgttaccccccggattcatagctggatacatttttaaaaaaattataagacactaaaaacccaacttaaaaatgaaaatttatacctgacaagtatttgttttgtcagaataccagcttggctgagtatttttgttactgtctccataaattttatatattttctgaataacatttatttgggtacaactgtaaaggaatggattagccttcatgtttgataattggagaatattgggtagattggtcatgttaccagaatgggcaaaaatggaccatttagagtgttgaatttaaagttagggtcctagttttctccaaactgttttttattaacttcaagattatataaaacaacatatttatgttatcttatgtatttgtgttcttttttaaaaaaaataagttaggcgatcctttctttatataaatcacatagaaatttatagcctagttgaaatgggccaccaaattcctgctaccttctccccactttttttctcatctagcagcttttgaggcatcactagggatccacaaagggcagtttgtaagaacactgctaaacataattattgtggtttcacacggtgtattttgccattggtagccaatttgttggtaaaattactaatgtaaaaataatttttagtgtatataaacatatcatttctgaccttgattcttttctctgcttatgtataagcatgcttatctttactgcaatatatttgctcttacaactattaccaattcgtagtatggagggttattgtttaaacttaatttaagaaagtaacaagaaggaaagccaccttttgtccagcaaccaaacttcccttccctccctttctaccatccaaccaatttaccagccaagcatttatccttccatccaccccacaacaattatttgttgccaggggatttagagataaatacataatcgttgccttcaaaaagccctagtcaattatattccttaggatactaccagcatttccaaatactctttagcacagattatttccttcaaattaaaataaaatgtgtgcatgactctttttttgtttgttttgttttgttttgtatgagagattgtgacttcaagaaagtttaaaagcctttggctagatactacattgatattgatctctttcttcttatacctttgtaatttttgaaatacatgagaaactgtcgtttacgctttcctttcattttccaatctcctattgtatttggcacatagagttgaaaggaaacaatattagcatttagtagcaaattaattttcgcagtaacaaatgacatgtaccaataagttatatttgttcatgaaaatacatttagagagttatattatgacttggtgaattttaagaccgaaaataaagagccaacttagcaaacctgtggctgatcaacacagattaagacacttctagtttctccctctttccattggtgtgtaccttaccaatcaacaccctcaaagcaattaaactatatatagttatccctaatacacatttacttccttgggcattagccagaatgcacattttatgatcacttatccttcaaatacaactactggtaattatctaagatgtttagatgcagaggtttgacaattagcaatcaaagttcatgtttgctaggaaaatgtacagcaagtcctcaaataacatccttttgctcaatgtcatttccttataagtttgaggggaaaaaatccattcctagctggagccattgtctgtatggagttcacacattctccccatgtcttgggttgtctctgggtactccagtttcctcccacatcccaaatatgtgtatgtttggtaaattggtgtgtctacattgttccagtgtgagtgagtgttggggggtgtgtgtgccctgtgtgagatgtcctcctctccagggttggttcctgctggtgccctgagctactgggataggctccagccacctgtgaccctgaactggaggaactgggtaaatcatttgttttgattaatctttcttaaatgtaagtatagcttacattcatctcaatgtttaatattaaatcttgtttatataaattagcctatgataaaattggtttttatatgtcatttcacttaaagtcagtttccaaggacctatcaacaacatgaaaagaggacttactgtgaacacatctgaactttcaaagcttgtgtagtagcattcaacggaaatgcataaacttctctatgcattagtacattaacattccctttaattgaaatgaatgcttacaagtgtgaaaagcaactaatgtagtgttatttaaattgaatgtaggctccatttttaataatagatagtctagaatcatagataaaaaggaatgataaataatacaatagagtccaaatcattcatctctgcatcactctacagaaacatgctgctttccatcagatattttttctggcatcaaacctctgtttttgcaaattacttttttttctgtgagtttttaatgttgaaatattttccacattagcatgtattgactcagtttactttttggtgcactattgaaatcactcaattgaacgggaacttatgccagtcctgagaggataagaaacttgttgaaaattatttttgccctctcaacaaaagacattagatttttaagtatcctagaattatcatgttatgtctaatagcagtcatcatagtgattaaggcttcccaggcctcaccaagatttgggtaacaaatgaagcaatgtagtagcttcgttcacccattttacttatttgaatgaaactggagaaaggctgggctaaaggaaagaagccctcactcccacacttaccctcttttttctcattcccttatgctatatttgtcttctttgccatattaaaccagaagcctcagccaaaatgaagagaaacacagaaggtatttcttagtttccaaagtacaatgttctgaggaattaagagagtttgaagagtaacttcctatgttcaatttggggagagttatgtagtaattttataacctccccactccaaaataatgctagtcataccagtatctgtcactcatagaaatgccttttctgcatgttaagtttaaaaaatgtttctatagggtgtgatgcttctgcttagaataagccacatatttagctgtgtgaaaagatgatggaatttagtctttttcttcttcccttcctttctttctactttcctcccttccaacattctctgttttattcaatttctctaaagaatgctggggagagcccagcctatcttgcctatttgacctttactctgaaaaggatgtatgtatgtctcgtataaaacatacagtctattctgccattttatatttttctacaaccactaataaccaaattgtaaataggggaatgtgaaagtcatatgaagtcatatattatcctatacagaggtttctgaaatagcaggattagaattattatctctaccaggaaaggaaaaaaaaaaaaacctctcaagtaacagccatatagacaagagaattttcaagtctgcttacaaaaaggaaaaaagaaaacaagcaaacaagcaaacgtgaacatctgcaccaggggcttttccccttgaaaggcacacgctcatctgagcatggctttctgccggtgtaggctgcactttctcaaagcctactgctttctgcaagaaactgtcacgcccactctcatggttttgtgtactttgaagtaccacctagttagtctccaactatgctcagctgcctacctaggttatccaagataatttcttagggggcactaataattgtctttggtaatgttcttgttatggagctgtaagagtttttagtggcctaccaaaaatttgtttttcctcataagccatattttggggatataattttacaaagagtaaagttgttcaaaaatgcatgtctccgggtatggtggaaatgcctattttatcctcctttatgctaatgcagaactcttttacagttttatatttgtgcactaagcaacattttgcaaacatggaaaatagcttgaacactggaatatatgttgcattataagtaattttgtctactttgtatgtattattaaatttatcttataggaaaaatctcaccctgaaatatggtcatgaattaaaggcaatcaactttcaaatcacgcccaccctttattttctcattcccgtatgctatacttctcttccttgctggatgaaatgagaaacttcagctgaaatgaaaagaaacacagaaattatttcttagtttccaaagtactatgtttagcgaccaagatgctgttattcaggcctcccagttgacagaatgacctagatctagagatcaagataccaccttctttagtgtatacaaatttccaaataaagaaagaataggggggaaaaatcagtctttccaggagggtagaatcttctacatgaaagcaacaaatatacttcttcagagcctaaatcaatctggaaaaccaatagaacaagacatttaaaagtgtatattgtgcctaatatatctcttttctcctccatatcacccagcacatagtacgtactcagaaatgtctgtaggaaacagcttattgtgaacaaattcacccccaaatgtatgaatttatgattatcaatagaaataaagatagttgtaagaattgaagaactgaattacacaagagtaatagattgaaaatttttatatgagcacagtctccttaccagatgccttacgctctaatgggtcaacaattgacatgaaaagaaaaaatacacgtgtatagatagatatatgtgtatgataaaatgtcaactgctattgaatctaaattttgggtgtattggtgattattatacttaaaaaatatttttctgaacgtgtaagcactttcacaagaaactaggagaagaagtattgttgcataataagagatgtctaataaaagagatattactgtgaaatcttttataggccctcacaggctgcaaaaatcattttcaaacttgtattatttagtttcaactatcctatccaacctgtattttcgtgtgtagttcaaatctctttaattatagttttcatatttatggcctttgatattcagtatggtagaaatgcccttaaagacatatatagtctcctaatttaaatccttcagtaaaactagaaatcgacattttctcgaatcttccgtcaaggagcagactgcctgccgtggttttattgcagtctggtgctttacaccactttcttctctgtgattatttgtgagtcattttgtaagtttttactttgtttcataaatctatactgtaaactttttaggcaatgattatcttaagtctttgtttttttttagttacctgtgaatcagaaaatgagggaatttagactatatcacattgttttgattttgatttatttaaaaaaaatctatgcacctttctgcatttattcaataataactcgaaataataataataacttgaaatctccctgaaggcaggaaatgttgcctcctgcgtttctagcacagtggcttttatacaatggctgcttagtaaatactgttgaattttgatgtaaaaggtggcacatgtaccttgcagatattttgtactcttttattatagcgcctgttttatagcatttgtgagcccttccttctaaacgtgtcccaaatttcagagagattggagtttgcgatagtgggtcagatttttgggcttagtcctgcaggcttatcatggatctggggcagtaatctaaagacattggaactgagatgtcatacccggttgacaactggggctctaattcaggtctgcgaggcctcattctctcattgacagaacgagagagcagattctacttttaggtatattgttttggagatccaagagctgggagcagccatttcttctcatcttccttttccatatttacagatacgtaggtgaccatgttatctgtaatagatattttttactctttgttgaaataattgggaagaaaattcttagttgtttggcttattatcaaattttcttagttttttatttaatctatttttatgacactttggatccttctgtttaagagactgcaataaatgaaggagaggaatgaagcaaataaacttggattagctgtctttgttgatatcgtttaggaagaaccgcatgccagtaccctaattaacaaatacatggtgtgatagtttatagttcaaacagtattgtctaaagtcgttttaatctatcaggtttttataggaagataccacaaagacttgatggtacagttacacagatttaattctatgaacataaaaaaattgattttcctgggggcattaagaactgtttttattgattgaatattttacttgcataaatggtagttcttaaaaacagctgcacattttactgttagtatctgaaagttcttaaattgtaggcgtaaatgtttcattttaattgtgcatttccatccttcaacccaagtaacaagaagataatatagagagtgtgtcatactttttctgggtacaaagatgataaagttgctgtccatactctcaaaataacttctttcttattccttttgtttctacctgctctaagataattgactcaatgggactaccctaatactcttgcagaatctaaactagattatactggacattggaagagtttacgtatcagaaaatgccattcctccggacataaggtagtgagataatattttagcttcttcaggaaaactttcctgaaacctcaaagctgaaggatgtcttggaagcattcgcatttctggcctccctcattttacagggctggagatgcaaaccacacacggatctagttggtgtcttctcatgaactagaaatcttatttttagaatattcttccagtgatttctgccactatagttttattgttggtttgagcagttagtattgaggattcattttggaaggaactgctagctgccaaccaatatcctttatttctttgtactttaataatagaacaccaattttattttgggcaaccatgtgcccagataaaatactgtaattgctaacacattcacaactaatacggtcatgtggctaaattttgtccactaaccagaactattatggggagacttcagagatgtttctggggaaatgattcggctgggaattgtgctgtcatcctcttgttccttctttttgctgcctggaatacagacttgatgactggagctttagtggctatcttggaccaagtgatgatcttgaagatgaaaatgctattctagaatagtggcagagtgagatagaagaagcctaaatctttaattgatgactatagaactgttataccagtcctggattgtttattaggattttttttttttcctgtagtcagaaatgaacttctcttttatttgagctattattattttcctcttacatgttattgaaccaattattgatgaaagagagtcaaactctgtaaaatattggaaaggatttatgtttagccaaatataagtgaccaaggcctaaggcacagtctcaagagttccggagaacacatgcccaaggtggttgggttacagaccaattttatacattttaggggacagaagttacaggcagacatcaatcaatacatgtaaggtatactttggttttgtccagaaaggtggtagaacctgaagcatgtggcagggggcttacaggtaatgggtagatttaaagatttgctgattggcagtcctttgacagggttaagctctgactgaagagatgaggtcagcagaaggaaatatttgtagttaagataaggggccttgttgaagccaaggttcttgttatgtagatgaagcttccaggtagcaagctgcagacagaatagctggtaaatgtctcttatcagaccttaagaggtaccagactcttagttaaatctctcctggatcagggaaagtcctggcaggggaaggagattcactacagaatgtagcttttccccacaagaaacagcttttcggggtcatttcaaaatatgtcaaagaaatatatttcagggtaaaatactttgatttctttcagagcctgctgtctgttgtgtgatgctataccagagtctggttgtaatagtctgtgtggtcagtcttaagatctctgtgttaatgctggccagttgtgcctgaattccaaagggaggagagtaaaaaatactgtatgtatgtacaatatgttttccattaataatagtccttgttctatatcagggtttctcaacccaaagttcatgaatttcttgaggtattatgaaaaactatacttgtatatacattttttttcctacaaaggtagtccattaagtcctcgagagatctggatatcagagacagtgctcaaaataggaagatgatatttatctagagaagggcttcatctattgcagagcagctaaagtagaagattatttgaaatgccgccttcaacatcataatcaatatttaatagcaatctctgaatgtctaaaatgacaggccttcaagttcttatttcaaatacctcttcctctccaaaatatttttcaaattgccaagtaggaaataatatttcccttttctaatttcccataatactttaatacatactctcttaaaatacttacctgtgtgttttgaacttcttcaagttccttgaaagccaatatcacatctagaccaccattaaatccccagccatttacaaatatgacttattcaataaatccttgttggatgaataaattcctgaatccattggcttattttggtggacacactacacttttaatatggctcttgtttggtccccaatccccaggccatggacaggttacctgtctgtggcctgttaggaacctggctgcacagcaggagatgagcagcaggcgagcgagcattacctcctgagctctgcctcctatcaggtcagtggcagcattagattctcatgggagtgcgaaccctattgtgaactgcatacgagggatctaggttgcaccctccttatgagaatcttactaatgcctgatgacctgagggggaacagtttcatcttgaagccatactccccttgcctggtccgtggaaaaattgtcttccatgaaaccagtccctgctgccaaaaaggttggggaccactggttgaaaacataggaaacttcagcctcaaaagtaatttaataggaaggctccaaattggatccaggtttcagccactagaacatagcacagagaaggcacagatggcagtccacagcacctggctgaaacacagattggcctcttgtcttctgtccctaaccatccagatgatagatttatgcacaagcgggctcagaaaaattagacttaagaagatataaaccattttctacctgggagatatcagttgtcagcattctattttctgtgtagtagttataaaacaaaagaaagttaatcaaatgtttcctctggatacaaattctgatttgtcatgtcattccaaaatgtagtggcactgtaaaattctaccagtaggaaagccatttactcttgatgacgtccgatgtgcttacagtcgatattgatttaattctgcttggttgttgtttattagctcatttcatttttactggggtattggacatttttagatatgtcaggaaaatattgttttaggattttagggagcttaaaaacaatgcctctctttctccacaaagttcagaagcaatggggaaacatatgtaacagtctgatacaaataaaaatataacatttattatcgatgaagtgaaaaatatgacatagatttgttgaccagtagagtgctaataattcacccctgaattaagtggatttacctacccagttactttcacgcttggacaatttcagtctcctggagataggctctgtgatgggtggttggaaagcagaacagaaggcaccatttttgaaggtaagggtttcagaaaaaagaatagaagaagagctgagatgcctatgttcagttcccttttccaaagtcactaaggaaggtccaggaatgttgtcctaccattgtttttccaaatggaaatatgtgatatgggtaataagtgttcccttgtgttaaggctctccagagaaacagacccaatatattaagaggtcatttattgtgggaattggctctcacaattatggagactgaaggcctaagaactggggacttctcatagaagtcctggagtctgaaggcttgagaatctggagctctgatatctaaaggcagacaaagatggatgtcccagctccagaagagagcaaaattgcccttcttcagcctttttgttctgtctgggctatcaaggacccaggtgatgcctgcccacattgatgagggcagattatctgtactttggaaacaacgtcacagagacacccaaaaatgttttactagctatgtaggaattccttaacccacttcagttgacatattaatttaactatcacttccttcttctttcatatgtatttcactgtgttcctctgacactgtttgaaattttaagtgatgtcatcattttcttctcactacaacctttaatggacactcttcccctattgaatcacatataaagtccttggcacctaagattactgtgaactggcccccagtatctaaaatcaatacctgtagttcacatccctatagcattttcaccctcaaatgacttagctcattatgtagtttttggaaaatccagaatgtggtacattttcacacctactgttagtagttctcaccttgacttgtataatgaaccatttaatgtcctgtgctcatgagtggcaacctagggagacctaagcgatcttcagtaagaagaggtttgaggatttaggggtgggagttaagtctcataagatccaggtgaagttatataagcattgtggcatatgaaatttcatatattttgtattaatattgctgattggtgatgtgaacttatttaatgtcattttcctgttcttgcctacccgattgaatactaaagagctaaaatttttattctctcttatgacttttgaatcccttatagagcacttaacagaatctataactattgaatttacttatcaattacttatctgttatctttctccctccacgggatataaacctcataattgtcatgtttgtctagctcttcaatatgatcggcaccacatagaccataaatatgagttgagtgaatcctctcagttatttacttgctcacttctactctttttctctacctttccacccacccataatcaactattactaaaattagaaacaaatgaagtaatttcaaatgccttatagaaatatagtaagtcaatggtagtaaaaagttgtttatatcatgatataatatatggccaattcattgaatattactacttaatttcatctttatgtatttttgcaaatatatatgaatacttatggagtttgaatatatatgaggaatatatatggagtatgaatatatatggattttgaatatatatgaatacttatggagtaaatactgattgcatttatggcaacatattcattaataactgaaacctaacatgagcactgctgctaggttgtgtggtaattacagttcagttattttagaaattgctgaaatgttttccagagtgtctctatcattttacattcctcctagcaatgtatgagtgatgcagtttctccacatcttccctagcaagcaatattttcgctaatttttgtttgtttgttttagccattctttttgttgttgtcgttgttgttgttggagacaggatctcgctttgtcacccaggctggagtgcatgcagtggcatgatcatggctcactgcagccttggcctcccaggctcaaatgaccctcccacctcagcctccagaggagctggaactacaagcgcatgccaccacgcccagctaatttttgtatttttttgtagacacggggtcttaccatgtttctcaggctgatactgaactcttggactcaagagatccacctgccttggcctcccaaagggctggtattacatgtgtgagccactgcaatttttcctcttattgatggtgcttttttttttgagatgaagtcttgctctgttgcccaggtaggagtgcagtggtgtgatctcggctcactgcaacctccacctcccaggttcaagtgattctcctgcctcagcttcccaagtagctgggactacaggcgtgcaccaccacaccaggctaatttttgtatttttagtagagatagggtttcaacatgttggccaggctgatctcgaactcctgacctcaagtgtttgcccgcctcagcttcccaaagtgctgggattacaggcgtaagccactacacctggcttgatggtgcttttggtatcaagtctgagaactcgttgcctaaccctagatcttgaagattttctcttgcatcctctaaaatagttttatattttatatttaagtccatgatctattttgaattaatgcttgtagtgtgagatttaggttgatattcatttgtctctggatatccagttgctccaacaccatttgctgaaaagcctatccttctgctattatattgcttttgtacctttctcaaaaattagtttgactactaatggatatagagtttattttggaggatatgaaaatattcctgattaaataataatgatggttgtacaactccattaacatactaaacagaatctataattattgaatttactaaattgtatatctaaagaggtgaaaattatggggtgtgaattacataccaataaaactgttatttttttaaaacttgggtggatttgtattgggtctatttctgggttccctacttgtattcattgatctatgtgtctgtctctctgccagtatcacactgtcatgattaaggtagctatatgtttaagccttattactgggtaaattgatttctctcatattcttcttttttatctagattgctttattctagggtgcttatctttctatataaattttaaagtaagttttaaaatgtctactaaaaccttacagggagtttgataagaattttattaagcccatatatttctttggggaaaattgacatcttttttacattgacccttccagttcatgaacctggtatgtctctctgtttacttagttcttcttttatttcttccattgtcatttagttattttcaatatgcagatcccatgcaagttttgtgaattttgtactgaagtatttcatttcctttggaatgattttaaatggtattatgtttttaattttgccttttaatatccatttttaatgtatacaaatacaatagattcttgtgtgtttatcttatgtcaacatcctacagtatcttgcaatattgctgaactcaacctttaaatttttaaggtttatgaatattggactttaaaagttttatattaattagtatttttatcttcccctgaataataccaggagtttaaaatgctaacttgaatcaccttctttctgaggcccattaattgcagcctagtattttagatttgccttcttttcacccttaaaaatccttattataagtgttctttttgttgcttttttagtcagtaattgtgtagatttctcaaagtgttattttagcttctaagatcatcattctttaattaacgtttacccagataaaagtataaaattatattttgacacttattttttcttaagtgtttgaaaatagtattattccattgtgttcttgcccctcctttctaatgagaattctgcatacaatctaattgttatttctttgtaaatacttgctttttgtttctggttgctttttaagatttttctctccatcttgggtatccactggtacactaatatgattggttactttaggctttgtttttattaaaccttttcaatgttcagtatgtttcttttttttctgaagacaacttttgatataattcattcttaaacagaatctatttgatatttaattgtcctttgagtttttttcttaattttttctattgaagtataaattccacatactgaaatacatagtcattaagtgtgcaggctaatgagtctttgcaaatgaacatttacctgtgcaagcatcgtatttgtcaagataaggaacattttcttccctgcagaaagttcctcatgtcccactttttcaagtcctcttttttcccccccgcacaatgtatagattgttaaaattgtactctctgctcttagatttttataatgaatttaaatatgtattttatatctttcaggttcttccattatttttaggtttttgcatgccagttaatacttgaaacttctgtttgctcctgatgatggttgtcattgcatggtgtatttttagcagatttttttgttaactgtgggagacccatatgctcaggaggatagacatgtccctatatagaaagtccattcatttttgtgaggtttcaaatggatttgtaggagtttgtctagtttttgtgttaacatttcaattccggattactagaccaccactaggaagtgtaaatttgggctttatatctgttcagattgaagttacatttgttaacagattttaccctctgtatccattttctattgctgttgtaacaaattattaatatcacaaatttcatggcttaaaacaatacaaagttgttctctgactattctgcaggccagaagtctaaagtgagcctatagggctgagttccttcaggaggttctaggggaaaattgttttcttacctttatcaacttctagaggccacctgcattccacagcttgtggcctgttcatataaaaagctagcagtgtaccatcttcaaatgtcactccccaccctcacttccgttgtcatattaccttctgtacctgtgtatttgatcctctcatatccctctcataaggacccctgtgattatattgggcccacccatataatctaggataacatcccatgttaagatctttcagttaaatcaatctttaaagtccctttcactgtgtaaagtacaggcggagcattcccaaatcctcccaaatctgaaactttttgagcctcgacataacacctagattccaccatttaagcaaccacgcattgtccacatgggtgcatgagatcctgacacctttgctttctgatggttcagtgtacacaaacttcatttcatgcagaaaattatttaaaatattgcatggaattaccttcagactttgtgtataaagtacatataaaacaaaaattaatttcctatttatacgtggatccaatctctaagatatcccattatgtatatgcaaatattccaaaatccaaaaatttttgaaatttgaaacacctctggccccaagcattttggataacagatactcaatgtataatatattcatagattctggggattaggacttgaacatttagtggggagcattatttagcctccaaggcctcctttctccaaattttagagatactccacttctttaacacttcatgtgctaagggtggagttttactatccacgtgtctcatggtgcattcctctagtatcccagttttaaaccagggttttaaagtttttgcttcatgtctcatctgtctctgcagtatattcaaattcacttgcagcccccagaggtactttcttgcacaattccaggaagtacatttacattagatagtacatgaatggcacctcctacagttgtgtagcctgacactagagccagcaatcagggctcctgtctctatgccttccatccaccatcagtggatggaaccttactactctggcttagcacttttgtttttcaagctcagctgtaaacatgtgaacaggtgttcacacataattttgttatttttctttccttttgtttaaccagcattttcgtggctgtaaagagagaaggcttagtccaccatattgttggaactttaccttcattttacagaggaagaaagggctttccatatgagtgaactgacttatctgaggacacgactaataaattaccgaatcacagctagaactttggtgtcctgactctgacacaaaagttcttttataaatcttagtaacagtgcttttattatgattattcctgttatcactgatactcattactaacttcccaaattacacaagaacctgatgaaaactatactgttgtatgtccttgtgaaccgcaacacatatacaataaaaattcatttattactgaaacatttttggagatatatcattaagctaggtgataggtatacaaaactgaatgagacatgatatctgccatcagggtgtcatagtctaatagaagaaataggtgcataaacagatagttacaatgcattgtgcccaagtatcatttgaactcaagatatagttaagctgttggggaaagtgggattgattagatggggaggagagagaatgggttcaggatgtttaatcttcaaatagttattaccagatagatggctggataggattgagggatgcatagatggatagttatatgacaaagcaggcatagtaagatattagttgtagaatctagaaaggagatacacagttgctcactgtatcagtctttcaacgtttgtctatgttcgaaaattttataataaatggttggggaagtatcgtcttcatctttattatagctatcattcattgagtgcttagtgtgccaggcgtctttaagagctttacatgatttagctcatttaattcccatatcatctgcaagataagtactatcattatccccattttacagaaagttgggcatagagaagttaagtaacttgttcaggctcacacagttagtaagtggacaacccatgataccaggctgtctgactctagaattttcactcttaactttgacagagctatctctaaaagattgagaggatttttttttaataaagtgggtagggatgaggaagcattacaggcaaaggagagaatatatttacatagataggaaaaatagcatggatttttcaaggcaaacataatcctgggtggtgaatggaatataaagcataaatcattgagcaaaggaggttactggggggttgggaggactctgtaagaactggccatatttggctttaccaggtagctgagagggatccactgaaggatttttaataggaggactgtgtgtttagatctctattttgaaatgggagctctgatgtcagtgtggagaatggatttcaactaaagcttttctttttttttttatttccaggtgaaaaatgctagaacaaaatagaacagtttagagatcaataaatggtacaagtaaagtgtctggaaggagctctctgcttccttaatagagagtgcattctgcagaagttgaaagtgaccctaatctgagaagtgtagtatttttagcactagtagatatgaagagggatgtctcgttttcagtttaaggcattattaagaagaagactgatttccaggtttatcctgacaatttccctcttcctttcaagaagaagtgaagttcacatttttctaccatcttcatgttttctggatcatatagcttttgtgaataggttgattagttgatatcggcttctgtttctgagaaaacttcagaagcctagtatttcctcaatggcatctgttgccaccacttctcattttgtgtgagagggttgagtgagtgggtgggaccctttaagaaaataaattgagagatgagttaattatacagattatcaatatacgggtattttctaaccattcttataacaaatgactcaatccgcattcctcaatgtatgctaaaactactgagtgaaatgctattggagaaaactatatgtaatctcaaagttgcttccaaatattattgacaagttacaaaagtaaaataatacctttacatttaaataacagagaaatattgtgatcaaacaacaacaggacaaattgaccataccttcctcctctatgtagtattcttcaaaacatttgaattaatcacaaaaaagcaaccagaaaaattcaaattgaattacattctgtaaaataatggggataggctctttaaaaatgtcaatgtaataagagacaataaaaggttgggggactgttctctataaaaggaaggtatgaccacaaaaagcactgtgtgatccttgattagatcttgggtcacagaaacaggaaacaaacaaaaagaagaacccacccagctataaaggatgttattggatcgatttggaaaatttgagtatagaccatgtggtaaatagtagttttgtggcattgctgcatttcttgaattggttcattgtattgtggttgtggagatgaatgttgtggtctttctggagaagctttatttggtgtattcttaggagaattatttactgacaaagtgtcatgatgtctgctattttcactcaaatgactttctaaaaatgagtatgacagagagagaaggaaggagggaagatcggaggcagagagtaaaaacagaaagcagacatcagaatgtttatattggttctaggtcaaaggcatatgtgtattcattgtgccatcttttcaacttttgtgtaagtttgaaatttttaaaaaaatattgaggggaaatgggaattcagatgatcaagttcaaatggaatgttctatagtcctatccaaacttaattacattttatgtgttattttagaccaatcctgcccaacagtttcaaagtttatacatttgctttatttttataccagcctgttgtgaatttgcaaactgtttaaaaattgcaaagacctacataaatatatcccttagcataagggtggccatgcactttaaaattacatatgattatgtggctgtgtcaccaagattacattaatttcatattctcagaattaaaggttgatttccctatatttgacatttgcttgcaatgttactacatcatatagataaaagaaggtagaaaggtgtgaatttaggcagaggtttccctgaaaagagcttttaaaatatctacttaaagagaaacttgaactctgctttacgctctgatttacgtgtgttctaaaattaagcctttcctctgtatctgggaatcagttggggagaaaacattaaaccattttctgaaagcatggaggaagaaaagcaggcatcttattcctcttttcactccataaaatatatataaggacaggttttgcccattttaaacagacactcgcttttttttttctaatgtaacactatggtaatcttaacaaatatagaacattttagatttagctttgtttctgccggttttcctcatgtggacgccttccttctcattttgttccatctgcaccggatctaaggagagacactttccctttaagaaacaaaggttagctgtgactcctgtcatgtaaaagcctaaagaaggcttttcatagttgatggaagtgatgccaaagaataaaatgaaaagcctctgctatctacctagcgcctacacgccctggagccgacaaaagagctcagtaccagagccgaagagtccgtggagcaccacgttagtgaaaaagccgattataaataataatgaccttagtggatgctgagaactgcactaaagtttttctgagccagacagaatgatgtaggggataccatataaatgcatagaagtctataagggaagaagatgctgagagattcaatttcttcctccaataatttaaattgatggtgagttagtaggtgctcaataaatatttgttgaatgagtaaacaaaagcagtctaacaacggatttcctaatgaaagttcatgaattgaagcatgtttgcattgcatcccaactctgtattaaaactgtatctatttcaggagtaagatcagaatcctgatagaggaacatgcaaaatgttgcccatctatttagggacaatcatagagatagaaagaaaaaagatatttggaagtacatggagctcactttgcctatgagttgtgtgcatttcgaggtgggagacgggagagggagtgcaagagaggctggaatgagatttttttttgtagtgatacttggttttctgaggcataatctagtgaggagagagggccttgacgtttttatttagcgatcatgcctccagtcatgtgttctgaggctcatgttcggttttgcattgatagacttggaattataggacattcttggcttttgaactagctcattgtgctgaatgtggtaatttttgtgaaagcatactgaaacgtctaaaataacttccaaggcaaaacagtttagtacagctactgcagctatatgtagagcaccaacatttatacttagtcgggttttaatctcagcactcagttcttcggtattccaactataagaaccccatcatgcttcccttgggccagggtatcttaaacatattgaggttaacatattgagccagataattcgttgctgtggggggctgtcctgtgcttggtaggatgataacagccagtagcacccctaccccaagtggtaacaaccaaaaatcagggttttttttaaactgtctttgttggaaggaaaatcagaatcttctgaggaaaaggatttttgttctcttcttggatgttaagaaaattggcttgtgttggctgggtgcggtggctcatgactgtaatcccagcactctggtaggcccgatcactctgggaggtgatcttgtgggcagatcacaagatcaggagttcaagaccaacctggccaacatagtgaaaccccgtctctactaaaaatacaaaaaattagccaggcatagtggcaggcgcctgtaatcccagctactcgggaggctgaggcaggagaatcacttgaacccaggaggcggaggttgcagtgagccgagattgcaccactgcactccagtctgggccacagtgagagactttgtctcaaaaaaaaaaaaaaaagaaagaaagaaaaaagaaaattggctttttttttttagccattaaaataaggataagtcagttctcccccaaaaattaaatgagaagtaacactcataaaacaatttgttctctctctcttttcttctccctctccacacacacaccccctcaaattttttgctaatagtgactacaaatttctgagcagttagtggtagatgaatatcaaggcatattgcacccttttatctagctcataggtcaatttgatgtcacattgacataattatttaaatgggctattttctccacagactgttttaatttcatgaccctggtctctgggtcattgttattagaatctgattatctcatggaaaattaatatggccacatattttcttatgtgcgtccatacttttggcttacttcttgaatattttattactggctccattgcttttggttggaaaagaaggttcaatcattgctgcatagattatcattccagtaggtgccctgggcagcaatttctgaaccatcccttttgaaattttgttcccagctggagaaatgtcacagttgtctcagcttttgactctgacttttagtgagagatgcaaggaataggaaaacactttcaagaagaagcaatgagcagttgtatgcacatctggtgacttattgctgaagattctaaagcatttaaaaatattgattaagcctcaaactgttgggaaattgttcccataactttcattctgcccctagatttgctgaggttttgagctgtatttagcttggtgaatcttgtgtaatggccagaaagagacctcaggagccccatcccccaggttcttattagccttgacaagagtgttgttaaaattgcagactcttcacagttccaaagagatgccgtttcttgctgtttcaataccaagtctaaaacaatctctgtatacattttggcttctaaaatatattctgaggtaaaatagcaggttctactgtctttgagaagaccatttcttttgtttgtggtaactagtcatgttggtctcttttttccttctctttgttatatttatttggactttaatgttggctatgccctttaatgaaaaaaaatcaggcatttcccagatttagatttttattataaacacttcatattttaagtggtatatctctagggagaaatgtatgaagaattgatggaagttggaaattttttagttagtaattaacacctaccattaaaaacaagtgcaaatcacatgatggcaaagtgaatctattacatatcataatcaaagattaatcaaagtaattaccaggcaaacagggattgaatagaacttaaaaccaattaaactatttcggctgtaccactgaataaacactttggtattttaatttctcctctcttcatttgcttcagcaatatgtttgctaatatgactgaggtgcacaattgctatttaattaacctatttttgtcagaacctcacacgagctgcgtggagtagatctgctaaagtctcaataataatgagcctgataaaaaataaccaacatgaaattcgtgccagtcattttacaagttatgccaaatgtaataatatctgaagaaaaaaagaaactggttaccttacagaaattggattgaaagtacttaaaaaacatgttgaaccaacacaaaattactcaaaagtttagtaaaatttcaaaaatgtataattgccttgtttctttgtaccccactttgcatatcattaccattaactattggtaataaatctattcgagggcatggatctgttttggggatacttgagttgataatgggcacagaagggtttggtagtggacatcttttacccaatcatgtatcctttgggagagaatacttttctagctattgagtaaggcatcacgaaagtgttgatccattttgcttttattccctaagacaatcaaaacgctaacacagtttgggtggtcttggcctcaatgatacacattttttcacaaaagataacataactaaccatgtgaagaaagcctcacctttctctacctttggatagtagggatgaaagaaagtaagatggagaaatccacattaaatataaagactctttccccacaaaatcccagagctcttctgattggcaccatgaagacaaaacattctgattggatttttggttcttcacccaggtgttttactatcaggtagacacagtttgtgtacaactaaataagaccatttcctgcccaagctgtcttttttccccacacatttaaaatttactcacacttactgagcatgatgtttcaagttttctgaaacagctggttagtagccagttgatcactggcccctaaaggtaacaaagaccctccatccccaaatttttgccagtcaaaaaagcatgactttatttcactcccgtcaccccagtgctattacgaggtgtaagcacctttctagtgaaggtctattttctagatcttaggacaagaatagaatgtcacattgtaagcgttctcagaggtctgcagcaaagcccttattgtacagaaaagaaaactaagactcacaaaggtgtagatcacctgtttgtttgtttggggtttttttttgttgtttatttgtttgtttttgcagcaagatgaggattagaactcagatttctgactccctcaatgttctcccttctttatcatacaggctccttaactactggctgctttgcgtgtggtggactttaaatgatcacacgggtgccttaatcacagcctttttatgagtgacacaggcgctgagtctccctttttctaaaatggaatgttttatatccataacccagacttgcttaactaaggtcaaatttacataaacaaatgtcttccggggccagcaggtagcatgtctgggcaaaagcgtgtgtggcaaggttttgataaagcgcagaacacatgttctgtttaaaaatgttcacattcagattctcaaatctctctcttgccagaccaagcatgtccacaggctactggtttataacccctgactgcatcacgatgcagacagagtaaggaggagtgttcttacagttatgcaaatggaatccatatcaccagttccttttagaatactagatgtcccaagtgtgccatgccaaacccttttgctttgaatgccctggacttctagtattcaatgaagaggcacgacttggggaacatgaaacacccccataaacaccagctttagttcagccagtgtccccaaagactgactctgaaaagaacatacacgtgtatgtcgcataaaatccgtagaagagatgatgctgctacccacaaccttcttgggagctgctgagaatccctaacagacaaaccgaatcatagggcaaacccaccctatgtaccaaacaaccagtgtaattatattctgtagttgaggaattacataaattgcccattgggaaagaagccttaatctccatccctcccccgaaatctatcaacagctgtgtgagcctctgtgtatttttgaaaggttgaacacatttgatcggagaacaaacttgatttcctaatcaggttcgatgcgaggagagccagttagagatgtgtgtgattctcccagtgtgcgtctttgattcgtgtgctaattatgtcgatcctttggggaacacagccaggaagctgggtcctccttgatgaatgctggcggagagccatgcagcgcgcagcggagagcagttcagcatctctagtcccagctgagaatatggtcccattatctcccagctgcctaagcaatccataagggcctgttctgcgtggatgatcagtgtagtggaagcagggacttgctgagagctgaaatctctgtttgatttgctgtaacatgtaaagcgaaactgggacattttactttacagtctgtaagtaccaggttttacccccctctttctccctacagctccatgtgaatgtgactttgcaagctgcatttgattttctgttccattgctctttgttgaatcaagctggtgaggtagagtgtgatctgtttagagcttgctgtttctgttaaatctcttatataattgattcatacaaggaaataggagcctttcagaatgcttttatagaaattagaaattattggctttgtttttaatttgggagtgtggttgcattatctttggtgccaggatgattagagcatatatttatcttcttctgtacctctggccattgcaagaaaaatgtaagtaaaactaatatatatataaagagataatctttatatgcatgcctgtataaaagaagtgcctgtatttccagaatttaaatttaacatagtttattttgctgttctctgctgctactaagaaaggcagaaacagaaaagtttctcttgtttttcagttgcatgctgtttagaaactttgccatggaggtgggcaggataactgtttggaatatttgcaaatataaactgtatatctccttttttatgagacagtacataaaataagagtctgtgtttagccccttattgcttttgaatgcaccacttcttaagaagtaatgtgaattaaaaaaacaaaaaaaatcactttaaatttggttcatttatctttttatgtatcctcaaatgccatctatcaaattaatatttattattcatgcaagattcattgtaaaaatgctattagaatttaatattgttaataatgtttgcatgatgtctttcacatgatcaatgccttagtgaaattaaagattgttatcactgtggaaagggatttgtggatttttctgtttccctaacctaaacataaatcacacctgtctttttttattaaaagtggaataattgagctgttgtaaaaattgaatttgaataaaagtggcttgaacagcatgaaccaatggccagggctaatgtgaaccaaagtgaacttaaaatcatgaatacctgaaaaggggaattgaagtttccacactgagcttgagaccatggagcctgatggtcccataatttccagagtgggaaatacagtttccctgagtaggcagtaagtctcaaggcagagaaaaaccacagactgtgaagtacagaagcatcttactggtgaggacagagtatgttctcattagatttggtggagaggaactgtgcaagagagagaagactcaaaatagatggttgtctacatgagcacaggcattttcagagcttgagatttggagggaaaatgatcacaaaacagtacagaatgcttaacatctggtaagatgaagcaaaagacggactctggtacctctgagtagcaaacagtcccagggctgtccttgccaagtaatcagttctctggaaaaaagtaagtgtgcaaaaaggcctgctaatgaaatctgaagtaacggcaagtggttttgatggctatatggtccctaaacaaaaggctggcctcatgccttcttacaaaactgaactgacctttgtgagtgatgattcctggtgaacccttagctatatttttaaataactgttagtgtttttctgactactgcaagtatatgatcttgtgcaagatgtgatcttgttttaagagggatttatggatttttctgttcagaaataggattagttaaggtccagtgattttttttaaacaaatgcttaatttgtatctacttggttgagtaaatagtgttcttttgagtttcgatttctttttttttcagggtcccgaacccctttatttgtacttagcagaaacgattgccttctgtagaggagtatcttcccaatgtagttaaatttgatttttattttccattcaaatatttagaaatttcaacttataccttacaatattaaacatttttgtagtcagtcaccacaaatctcagagaggtatttgcaagatttgtagtttgcttctattactttcggaatgtttagataattttataaaattgggacactgtcttcctagttgtttgcttaatctgcaggaaagtggattgaactctccaggggtcagtttagggtatgtggtctcttgacagatcgggaagccagatataccttgtaagaggtacttctaaagccataacaatttggtcttcaaaataaatttaaagtgctatgaaagagaataaaggaaaagtcttgaattgtatatgtaaagatagtgcatctctgtacgtgtttgcatgcatacaaatctacccaacaacattgtggacaatttctgtgctacccaagtacactagctctttagttcctagaaagccctggggttgagccaagtggaaagaattttgtaaattgggatacagcagcagagagttaaatctccttgcattctttgttttggaccctcggcagactgttttgtttgaccccagagctgccggcttaagcacaaagaggactttataacgtcctcagcggcatttggaagcaggacctctgcacacaaatcataccctaaccctccttaacagcttagggcagccactgtgaagcaaggaatgcagttctgtgaactgtctctatgatgacaagttaaagagtgaatatgagctgggtgtggtggcacaggcctgtagtcccagctaccagggaggctgaggtgggaggataggtcgagcctaggagtttgaggccagcctgggtaacttagtgaaactctgtctttaaaaaaaaaaaaatgaatatgactgaatgaaaaataattaatttagtaactgtaatacttttggatgattttaaatgttatcaagccttaactgtgcattgtcaaagtatacactccattggttatctctagtaacagtgaaagattgagttaacctcctgtaagatgctgtgcaactctaacaagctgctttacctctctgtgcctcaatagcccccagtaaaatgaagtatgatttctgtgatccttccgaggttaagaaagttacgaactcatgacatcttattctaactgggcattcatgcctggaacggccttcaaattgcctagggacagggtgacatgtgacttagctgtcattttaaacaatatttcactaggatgctttcattttttcttctttcatttctctttctttcttcctccctttttcttccttcccttccctccatcttctgctaccccctccctctctctctttctacccttctccttctccctgtctgtcccgttccctgttctcctctccctctgcctccctctctctctttttcatcagttaattgtcctcaagtcaagtgtgactttagaaacgaggttcggattgtctgctcatttgcataacctgtttgcggctttctcttatgatagttcattgaagtatcaatgacttactgatatactgctctgttatatattagaattacttagctttaggcatgtatgtgcagcagggacccagaaagttatgctgcatatgtaagtgtgtatagattgcccatgttaatttttaaaataagagtgttgttaatcttatactctaaattgaagatgattaaggtgaaggatttatcttaatgtattaagctaacaatatttactttaaaaataaaacaagtgcacaaacaatagcccatttcaaggtagcaggatattaaagagcttgatttttaaaaagagaaaatatgttcatcgaatgatttgatttttctgtaagaaattgtcttgccaaacagtatggaaaaataaaaggcatacatcattttattaacaaatagatacccgtccacataatgaagtaagcaactttgtgaaacatgagataggaaaaatattttatggaaagtttttttaatgatacacttcttgtaatcttaggattgcttatcactagataagtcctcttagttgaaaacagcagatgaagaagttactaaatccatcactaatgagtgcttcttgatatactcgaaccaacttgtgaatacacttcatttgagaatctttactgcagatactggaaaaagctaaattaatttcataatttatacttgtaggacatggattgtagtgctttttgtttcttccactgttaaatggaatagatggaatggcacaaaaatttacggactaatattttactgtacagttgactatatatatatacacacacacttataaatattttttaacatcaagtgtactccaagatggatgataagtggccatttgatgacagtaatagcttggatgggctcatcttatttcagatcagggtagtgttatgacagcttttaaatgttagttgaaatactcatttttctctccatttttattattgggaggtctctatatgtgtcttactattctggagtttgaatattaatgttattccttattgaacttgtaggctatatttgatgcatatatatatatatttttgatgcagagtataaaattaattttccaaatctcataaaactgagtagatatcctggctttttaggcagcaggcctgttgtaagtagaatccgtaatgtgaaataatttgttttatcgtcgtgcatccatctatgaccaaaatgattttgtacttaggaactatttcaatgcaaactagattatactgacagataatgtttgataatttgtggctctcaaatccttgattataaagttaccaagcagcttcagggacattgcttttggttttaatctagtacctctgttgacttgagatgttcaattcaatattacttagttaatagctccaatggcttatccgactgttttattgtatagttaaaaaggtaaagtaaattggacatagacatgactctagggcttgtacatggcttcatgtcttcacctctattccaaagtaagaagggaagtccttctgcatttttgcatgaaatttctctatgttttaagggaggaatggggtgatttaaaattgagaggaacacatcagaaggagctgcaaaggaataaagtgtttcttatggttagatataaaatgcagggctatacattctgaagatatggcagaatttagagaagctgactatgccaggcatttggcacaggggactaaaggagacagatttaatgcttgccagaaggaaaccctatatcagtggatagaaatttgagtgccctgcaagcaagcaataacaaaagaaagaaagaaaaaaaaatgtaaataaggaagtagaggaatgactgtattgtggttggaagagatgtggtttcattctgcaaaggaaaattgtgagtgaatgaaatatatcaagtgtaaggacattgggactaattcaaaaatattttgcataggtattgctaagttactgtgaaataattaagacatttggatcagtgaagagatacagagaaaaaggagtgctgttggatttgactgtactggctgacacactttaacaatgtaattatcttaaatgaagtgggtattgtgacaccgtagtcagtctgtcttatttcagtgagtgtttctggagtagttaatggggatattccatctagttcagtagatattgataaatatgtatttatggaaactatatagcagtttttacaggctgccagtaaattaccttgatccttctaccaatgtctgtgtttctgatcccccactcctccctccaatgatctgtattaccccaaatagtcctaggagatggtgtgagaagactgagtttgaggaggttgattttattaaatcacttcaacctttcagagagtaaataagttcttacggtagggcgtaatgccatgcaatactgaatgacttcttgaaatcctttcacttcacttttcctttaccaagcactttgtccagagtaatatgtttaggtcttccaagcatttagataaataaccttgtctgctggacatggactcaatgagtcataccactaattaaacacggtcatttgcaagaactttgcctcctcgctggttagaattcattgtatatgtgtgtgcctttcagataggtaaagctgctcacacacaggcataatgcttgactccaggggtgaaaacaaccaccatctctcagaagagaacaaatcatgtgttcaaacatggtctctggcatctttttgatgtgtgtgttaagtgtgaatctggtaatttaaggtgtgtgactcctactcccatccagctgtctggctttgtgcttagagagaagaatagcaacagatttagactgacacaatccttccctagagtccccctcccctacctctccctgcaggaatccacaagggtattcggttgattgctgttgttaacctctcttgtagtattatatttcttgttgaaagtaccttttgtggcatgtgagtacatttaagagatgtgaaaggctttaaaaatggctttacttttaaactttcttacctaaattattaggaggaaaacagtttcttaggttaatatgtgtgtgtgtgtgtgtgtgcacacacgcacatgcacgcatctaggctaagatctttgcaaacctttaatgttcatcaagggctgtgtctaaatgatacgttgattataataggattttttttccaaatcattttcgtaatacatgaataatactcagaatgttcatgtaaagtgatagactgaactatttcacttgagaaacattcttgatgttgtacatgacagtcttcggtcgcaaaataatctagaaaattaggaacatgtctgcaagtctggttaaggctctgacagttcttctaatatatctgttttggtgaactttgagcatcacagagttttctcaaggtatgaaataaatacctctggtagaatgtttgataatctcagagtactcaggaatttttaatagatatgttaaagataaaaaatatataactagtaaataaaacatatagttttacagatagaattgtttagcccatggctaaatggataaacctaaaagttttgataagcaattttggaagcgattcttgaatgtagcagaacttgtgatgatgatgtggaagtatagggaaggtagaactttgcctgtgggcctgagacttaaatctacacaaaacagactaatagaagaaaatcatacagatttttcacatttacatgggagccgccacaggaaaatgaagacccaaagaagtggcaaaacctaagtgcttctatattaggttgaacaaagagaggcaattgtaggaaaataactaaaatatatggggcaactaaagaaaaatatgagttattttaacaagatctgtttgtacagaatacccttggttttgactccctgtctctagtgataagaatgtttcttttctcctggtttagggaagacatctttcacataggagttttatctcctgatgtgacaatgaaaagggaagatcggcttgccctccttgtaccaactgtgtttcaagtgtctttagctcaaaataatccttttgccaaagtggcatattctgataagggctcttctgccatccctcacaagtgaccttgccataagttatttcttgtgtgtctaaggatgacaccctagccaacaaggaaaatggtgacattcaattatggaattttaggcctggacatgatctacagattgtcttgtctgttcctctaccagtaggtccagaggcttatccaagacagaatggtcttcttgtagtctgtctagggatagaatctagaatttccagagccccatatgggttcccttctctggcaagaaagtcattcttgcatttcttttcacattctgtaccacgaagctagaactctattggcagccagataacccagaaccaaagacctgcagaaaccaggctgaacacacgaagtgtgaggtggaccagttgtcaggcaatagggagtccacagggtctgtaaagaacggtgcatcagggttcctcctaagtgttgtggccatgttggattgtggggccagtgttgctgtatctcaaaaattttaaatattgctgtttatttttaaaatgtgtgaaagctaaacgcatctatcgaattcataacatccagttttcaacttctatggtaagttatttgaggcatctctcattggttgcgggaaaaatatgcggattcacatcatgaagtggcatatactctacctaagagagggaacctgtgttaatgatccatcttgggtacttctagggaggaacctaagagaatgaggtaaagcatgtaaggattcctacaaggctttttttaaaccctaatatgtttcattcattgtcagtttataaggatcagatttaagaaatcatattacaggtatgagtctgaagttaatgacacagaattcaataaatatattttgctatgcctaagtaattcaggtcaatagactatattgtagttactgattttactaacatatttaatatttttatttctactggggtgctaaagttgccagtcatgatttacattaccatagaaaaagataggttggtgattgcttcctttttttttttttttttttttttttttttttgagattgagtttcactctgtagcccaggctggagtgcagtggcacaatcttggttcactgcaacattcaccatctgggctcaagtgattcttgtgcctcagcctcctgggtagctgggattataagcacctgctaccacacgctgctaattgttgtatttttagtagagacgggggtttcacaatgttggccaggctggtctcgaactcctgacctctggtgatccacctacctctgcctcccaaaatgctaagattacaggcatgagtcaccacatccagcccttttttccttttttaaaaaaacttttgatactcactgattaattgggcaaatagaggaaatctgcaaatgagagggatagaaaaatggtctaatttacacttttttttaaaccacaagatagagcctaaattccatttaattttccactagacattttagacattctatctgataaaggaacagagaacacagtgctgggctgtttaagcacagtcatttttcttgcgtacctgtgcagatgacagaatcaccaggtggtcccatcttgaggaccactggcctatatttattaattcatttaacttattattaattaaattcctgccatttacctcatactgtttgttctagagttcagagatagaaaatgaacaatatgaacaaacaaacaaaattactacccttacgaaagtacgtgcattctagtatggtgacaaaaaggaaaggcagtgttctccaagccaccctttggatctgaggcgccttgtccctattttcactacttcttcttgctctgttggctgttttgcccagctgaacatacttctgtggtatttaagttgatctcatataggccatatgaagtggatgaacaaaagtttttcagatatttttgtgaactcaaaattatgtgggcctagaatagctgagtaattgaggcaaactcttatttgtttgaagataggattttgtaatcaggccatccagctactgaagcaggcctctgcttcattttgtttctgtgaacaagggtggacctctacccatcccccccaccccccgcaataagtcactcatttctcaggtgtttttgtttctgcctgccttaaatggtggagttgaccaaattgactattttgaaacctatttataacttctagataagggtacagccatccctccctaggacatggttttaagtagagttgaatgaatatgtgaggaaggaagcattttgagcttttttgaacaagttttacaactgcaaagtgctattactattaaagataataatttagaagtaaatattatagcaactaagtgcaaaagagctcttagtgcactattttcatttcaccgtataaaaagaaaattggtagtaaaatatatagtgtttatctactttgtaatttctttcccccaagtctattgacttttctctcccttcggacttccctttggtaactcagaagcttacctaagttttgaagtagccagctagaaggagttacagagtagatgacagctttgtctttttttctactatcagagggctcaacactgtggagtgatttgtgggggcatctgacatcatcagaggcgcaaaagtaatcgtgcttatcactaaagagagttggctctaagctttggtaaagtggtcctgatcccgtgtgatcctaaaaaaagatgagaggaatgatcattactgtttggagcctacaggctcaataaccttctaactctgctttttaattaaacacagagcacttaggggtttatttatccattatcaggcaggcaaatcctctactgacatcattagattttatggcatgtggcctgcctaagcagtttgtgtgtgtgtgtgtgtgtgtgtgtgtgtgtgtgtgtgtgtgaataattaatatgaaagatattacattactaccagtacaatatgctttacttccatagtctagaaacatgcctttttatgcaaagttgcaacatgattcaaattgatgtagtattttaaagttaaagctctatactcagtattaacaaggtggttgcattttccacagagactctaacaaacgatgtagtcttaaatatcaattgatttacaatatctcttagcctgacatcaatattaaggctttaggatagctctcacatgagaaatctgatattttgaactttggatcataattaatttcacaatacagtattgttatcttgtattacatattttttctcatgttaatttgacttactggctattaataataagaaacgcactatttcaatgaccgaagagtgcaaacattaggtagtgatgctagtagaaaaacagtttggacagtgcttcttaaacattagtgtgtggaaatgcagattctgattcagttagactgactgggactcaagactctgaatttttaattagctcccatatgatgtcagtcttggtggtccacagataacacttgagtaataaggataaagaccatgtggaattccctgttcagcccacatgagatttcccaactgaggaattctttcttgagtgtctttttctttcatctttgtctcactgtattgttatttgaaatcagaaaataaaaagtactagattgatagctctgtccacctgtcaagtgaaaagtttgcatctcattttgtattacactattttatgccctaaatctttgctttctgtcctaaattgatctggtacatctttgcctgacatctgagtcttgtagatagttatttaaagatatgtgaagtaaaagattgtgaatgtcatggctagaatagatgctatctccagagtctaggaattgaggtatgtactggagacaaaacagacctgttctatatggaatgttctggagtattatgaaagacactcttgtttgtttctttatttttcaccctgtggcttatgaaagtgaaatgtgggcttttctaatatatgcattctctagtttcctatacactgttgatttccccttagtaacattgcatattatgttgctcctagtggtgacaaatctcaggaaagcaagagaccttaaaaaaaaaaaaaaaacaaaacttttttctatttgtgacatgatgacagctgtcatgggaatggggaaagatagaacagtttttcagaatccatcaagtgaaggtacattcaatgctgtaacttaatgaaagttgctttattgtgacatgagtcagagtctttggtgatgcaagtgtggaaggatcttttctgaaagatttatgcctcaagtctggatttgagctgaagggacatgaccttggctttgaacttgaaaaaggttaccctctgtaagaaagtccagagtcagtatgaagaggttttcagatcaggacggcaacagagagtaaacaacactgcagagtctctctgaaatgtgcaaatatcatgacaaggagaggtctccttagctttatttacccagaatcctcacgtaagaggtagtcatctgggtgcttagaaatcaaaatgaatgactcactttttcaattttcatcaaaataacccttgttttgtaaatatacacaaaaaaactacccatcatttgaaatttctattgtaaaccccattgtgaatgtattattgaaaagattggaaaaccttaagggaaattctcaaccaaatctttttctgaacagcttttttgagtggaataattatggtataattcttatgtcatacaactaacacatttaaattgtacaattcagtgtttttagtgtattcacagaattgtataaccatcagcattatcaattttagaatatatttgtcatcccaaaatgaaaccccacctgttcacagtcgcttcccatttctcctcaatccctccctagaccaacaataatctctttctctgtgcctcgtctggatgttttatataaatggaatcatacaatatgtggtctcttgtgactggcttatcttgcttggcatcctattttcaaagtttagccatattgtcgtgtgcatcagtacttcattcctttttatggccaaataatatttcatcattttagatatactacattttatttatccattctttagttgatggacatttaggttgtctaaatattttgactgttgtgaacagtgaccctatgaataatctggaatcgtttttgtgtggacatacacctaggagtggaattgatgagtcagaaccgaagattttaaccaatatgtttaaattttagcaacactgaaatacagtggatgtaactaaagagaatatggaaatggctataaacgaaaatgcttctcaatgaagagttttactcatttgaacaaaggaactatccctcttatttttttagtctctataaagtaaatgttcccaacactttttgtccatctcctctgtcttcagtagtggcacactgtccatgaattaaggatatgaatactaggcaggaagttaaattctgttctgcaaaaaaagagtatgtcatttctgcttattaagaccatgataaatgcaacttgaataagaagaataattgtttagttaacacaataggaaaaaaaagtttaatagaataccagctcagccttttggaggcttagcatatttgaatggcaacatagaacactgtagggaaactctcaacctgtctctaaaatccagagtttgaagatgcagtaaggttttgagcttgtattttctcatccctgaaagtgccaattaagataataaaatttagagcctatccaagttggaattagatcttcactgtgtgtgtcactgaatatgacgacctggatgagaacacctattagaggggaggctcatttaatgcactggagatagctatggtgttcatgcagcatgcactgtggaaggctgtttggattgcatttgattaccactgctgtgtgtttgatgttttgcaagtattctatggggactgccttttctttttccaattgaaaataggctagaaaagggatataaacatgttagtgctctgagaaaaaataaagatattaatatatttctgcaaaaattgtctttcttgacctgaatcataaaaggtattgtgaacataacaactgactggatattgtttatattgtcggtaaatttcagtcagttgaaaatattttaaagtccatatatatctgtgaaaggcatagatgtaagctgcatttaatgtgctccaaaatcaaacaagcaagtattttacttaaaatgtaggttattggcatacctttgtgtgtatgttacttcaatgttgaacacaaggtgtaaaaatacagtattttacatttctgcagaatcttgtcactacagttttctttcatttgaacttaacagatgccaagattttccatttagtaagtattattactagcaaatatattatctggaacacaatcagtatcaaattctggctttctaagaatattgaaaatgtatatgtagaggtgaatattgcagataaactgagtactgaaggaaatggttgattaaatattattcagtttgctttgtagtatgatgaaacattttatatatacatatgtgctagcacacacatgcacaaacacatgcttacattgtcacagggaaacaaatacacattatacctccacccccattgctactacaaataaaggtcttaacaaggtaggtttcttatcacacatcttacagtacatcagttaagactgaatcagggacagcacaagacaaaacagaatcaaaaaggtagtgtgactgcagtatatactgtacatttagtgagtttctatttataatcccgcccaccctcctaacacattttacccatccctggcactatggtcctccctatgactcagctcccaggcccttcatgcgccccacaatcttttttctctccaccttctcatttctctgtctagatttattcttagtaaaaactgagaatactctgtttcagaagttgttagaattatcaaagttaaaagaaggaaaagaagctggtatttctgcagtgtatcaggtagtttcacctacattttatggcatatttaaaggacaaattcttccctatgactaaaattctcctgcttggaaaacaaataccaaaatcatagccattcctagtatctgtaattgctaaaaatcaaagttgtcaaagttgaagtttatgaatgaaggaaatatagttgtataaaagcaaaaaatgtgaaaacttacatagtaactaggataaaataatccaagaataaatttattccagtctaagaaaaaacttgatttaccaaaatacgtatgggatttagggtaactattacatgtaaaccaatcatgtacttttttgaaatggtgactgttgcacactttacattctttctcttatattcatgaaatataccactaatattttgatataaaaatatcttccctgaggtttttttacttaatatttgcataaataggcatacatccatgcttgggaggcaggttgagaaagaagattatattttactgaaaaaaattgtgggaatcatagtcttacaagtttactggagctgctaacagagcagcatatgtgcaatgagaaccatccttgataactggtttgcttagccactgcccaaatctctagatctgaatcttgttttcattgctgactttctttatgaactcagacacataccattaacctctctggactttggatactttctcagaaaacgtagaagacagattgattcttcttaagccttgttcctgtcctggcattccttaagaatgaggttgcatccagctgcagtgtgggtgcacttgggcttagtgctttttctgagacactgtgttgagcagagatcttagccatgcactgttggtgtgaactctggattccttctggtcattacatgtcctctggcactgttttccagctgagggctgtgacctcagagccttggccctgtttcatctttttatgtggatgtcctctgaagttttaattgcttacactgtcttcctttttgctccctgttctgtcaccttagaagtggtcgttaaaagctgccattttactcttgaggactggcacaccaaatgagggaacaatgtatgctgctgctgctgctgctgctgctgttgctgttattgttgctgcggttgttgtggttgtgtgagtttaggtggctgtggagaaacgtctttcaagatttagcatctgaaacgagaagtgtgttgaggagatgggattttcatatcgcctgttctatctttgcatgcggtgtaaaaggtcaaagccttgcttcatccgtaaagcaccttctttacataatagcgagcattgactctgggcatagcttatgtcccatcccctcttttcctgaggattactttaaatagaaatacctgtctattatttaaatataattttgtcctctttgtgtcttctgagagctagttgcccctagatgtctttcagccttgctcttcaacaaaaatagaacaagtttattggtagcccttatgacacatcccccacagttggatacttgatcctcccccttttaaatctgccctcaattctttctaaagccatctctttctaaagcaagagttctgctttccttttgttttcagatatatgtcccttcccgatgtctcccttcatttctaggtttcagttttcaatgttctttcatttggtcatagactttttctgtgttctttctaaaacaatcagtgtactttcaagttgtcacttttcattctcagctatggggtgaggtaagtaggtgttcagatttttattgatgtcaaggcctcctcttgtcgctgaattggttgcatcttgttcacagtactgagtaattattaatatatcaaatccaagctcatatgttgattggactgcctcctttccccatggatgttgtagtcttgattctttgttgtatttcagaaaggaaacctctaaaattttattattttacatttgaaattgttatttctattttattggaattggattttgattgtgtattatctcatatgtggagaaatcaggaatatcaaccatgttatgctacactgatgatcagtcaatgcattggcccataaaatgaacacagttatacaccagagatcaaatcattcccattaaaacaactagatgctaaaatagcactgatattaggaaaaccatgctatgacattaaaataattcaatccaaggtgaaaccgaaactgatttgtctgagattgtactactttactgacccattttattaaacgtaattttttaaaagcacttttaggaggtagatagtatagtgcattattgagattataggtggtggctaaagccctgtaagtatattactgaaacaaattttttcaattctctggtagaatatgaaccaaggtttttttcaatattagcctttaaaaaactcttaatactccataattagcctacaatataataatttgtttccacctttagtatgacaagctatttcttgatttttttcactgagacataattatatatatttatgaagtacatagtattgtctcaatgcatccaatatatagtgattaagttaggttaatgagcatatcctgtcacctcaacattcatcatttctttgtgttgagaacattcaaaatcctctcttctagctttctgaaaatatataataaattattgttagctatggtactcgtacagtgctatggaacagtacaactgatttatcctatctgcctagaattttgtatcctttaatgaatttctccctatctttgctctccccactcttcccagcctctaaaagccactactctactctctacttctaggagatcaacttttcttagcttctacacaggagtgagaagatgaaatatttatcattctgtgcctggcttatttgacttaacataaagtcctctggagtcatccatgttgccccacgtgagaggatattactattttttatggctgaatagtattccattatgtatatatacgtattttcttcatccattcatctgttgatggatacttacattgattccataccttggctattgtgaatattgctgcaacaaatatggtagtgcagacatctctttataatactgatttactttccttcagatatatacccagtcatggtattgctagataatgtttattgactttcatatttgtatggagtagaaaatgtataatatgtattatgatttgtaatacatgtattacttactatatacaaacaacagagccaataaaatgacatagcctatctgtcaagaaatcaacatgagaggagacattgttggtttcaagggatatgccttttttcacaggtaggttgatctttgcataggctaaactattcacactctgtttagctgccttgatcgtctttactcttgtttgagtaacttggtaatggtgaccaccatatgatgaggaggaggaggaggaggagaaggaagaggaggattatattattgaccaagatgatgacatcactgacaatagataataccagaatatcttgaaatcctaatcctttaacagctgctggtttgattccagttaggcttctattttcttggccctagtgcagtagatgagctccttgcacttgatatattttcatcaatgaaaataaaaaagtgaaaatgctgtgctttttagatttccctcatgtgatgcttgggctatatcatcacacttcctccctggcagtggaatcattaccttctgctgttactagtatagattttcagaaatcttgtaataaatccactgatttgagagcagtaggagcttttctttctaggttgcctctccaacattttcatcttgatatgcattacttagaattcagccaaaataaataaaatccagctctgtcactgcttgacaaatataatacattgtcagtgtacctgtttatttcactaatatactctattttcttcttctttctcctcttcttttttttttttttttttgtgactgagtctcactctgtcaccaggctggagtgcagtggcacgatctcagctcactgcaacctccacctcctgggttcaagcgattctcgtgccttaggctcccggatagctgggattacagatgcgcgccaccatgcccagctaatttttgtatttttagtagagacaggggtttcaccatgttggccaggatggtccccatctcctgacctcgtgatctgcctgcctcagcctcccaaagtgctgggattacaagcgtaagccaccgcacctggcctctattttcttcttaaaaccacgttgattgggactatggcctctaattttctcataatttagctgttgtatgttagcattgtcttttaggtgctatttgcattttccttttattatttagagaacacttatgtagccagatttttttaccttgagaaaatgttcttaaaagtgtaactcccgtgatctaagaaatgtcattcagccaagaagttactctaagctttattgtctgaaataatttggaaataattctctttaaatttcaggaaaaagaggacataaaccactgttatagtttcagttgtttttaactatgtgttgaagctttcccagtctcttaccttgtttattcagttgtgttaatttggcagttaaaagaattgtgccatcttcatagatgactcatgtggaagtatactatctctactaacagaagtgactacagacatccaaaaatgaatgctaagcctggggaaagaacctcctaaaaaagagtcaatatgtttgatgacattaaactgcacactatcatttgtgagtattttcacttgtcaactggaaaacaacggcaggtcttgagatctacctcatcctcctctgttagccaggaaaggagacaaggtgttgtcttcagggtgttttcccttcatcatgggccacttggagccaaaaacatcaagggaaaggaaggagcttgggcgggtaggcctgggtacgggagatacatttttgcttagttttcctcagggatagtcaggactctataattagcagtctagtcaaagagaagtttggaggaacaaatgagggaccttctccatctccattgtctctctatgccttcaaccagggaggcagtgagtctttagggatccaagctgttacccctagcttgttaacatttaataactacatgacctaaataatgttgttctcttttcacaattctcagttgcaaatgggagagtagtataatgattgccattggatgtccatttactctttcagccattgaccgcccttattccattaaacagaaagtagtgactctttcctgactctcttaacgagatttctgaccttttcccctgctttatattgtctttagaagtaaagattccatttgatgagtggaattatctcccccatattaatggtgatgaatgctcttgagaggctaatgcatgcaatttaacaaattcaaactcgagtcaaaatctgtcttaatattcataataagaacttatgtgatgtccctgacatccagcagaaataacctgtggcagtgttcgctctaatacttgatcttgtaagagaaaatttcaaccttatacacattttagaattacaactgagccagcattacagtgctaaagaatgagaaactgttgtgttgcctgtttttgaaatgtaacaaaagccatgttttgagagtaattgacttcttaactcacactggacttttcatgtcttgagttccctcaacctgtattcttgtggctgattttgctaaatatatgtacttataaatctcctgcttattggaagattatacatttcaagttcaaagatgtaaaatagactagtatttctctattttgtgagatagtttttcctaggtcttatggcaggatttggggttttgttttttgtttttttgagagacagcatctcaccctgtcaccctgggctggactgcagtggtgcaatcatggctaactacagccttaatctccctgggctcaggtggacctcctccctcagcctcctaagtagctgggaccacaggcatgcaccaccacatccatctaacttatgacaggttaaagggagaattctttcttttgaccaaaatgtttgtactaggaacaaaaaataaaaatagtagccatccctagactctgtatttttgaaaatcaaaattgtaagtagaagttgactaacgaaggaaatatagttctatgaaagcaaccactttttaaacttcctgctttgcacatagttaactggaagaaaaggaaaccaaaaacaaatatattctactctcaaaaagcttaatttaccaattattagtgaaaactattgtaaatattcatttaaaaacaagagttgtttacattcttaaaaaagtaactatagcagtcttcatactctttcgtgtcatacagtaataagattatattttgatagaaaaaagtcatatcttccctgaagtttttttatttaatatttacataaatagacatatatccatgcttgggaggcagggtgggaaaagagattatattttactgaaaaacactgtagaactcatagccttacgagtttactggggctgctaacagagcagcataagaaatgagaaccatccttgatcattggtttgcttagtcaccgcccaaatctctagatgtgaatcttgttttcattattgactttctttatgaattcagacatgtgacattaacctctctggactttggctactttctcggaaaatgtagaagacagattgattcttcttttttttttttttaattatactttaagttctagggtacatgtgcacaacaggcaggtttgtttcatatgtatacatgtgccatgttggtgtgctgcacccattaactcatcatttagcattaggtatatctcctaatgctttccctccccctccctccaccccacaacaggccctggtgtgtgatgttccttttcccgtgtccaagtgttctcattattcaattccgacctatgagtgagaacatgcagtgtttgattttttgtccttgcgatagtttgctgagaatgatggtttccagcatcatccatgtccctacaaaggacatgaactcatccttttttatggctgcatagtattccatagggtgtatatgtaccacattttcttaatccagtctatcattgatggacatttgggttggttccaagtctttgctattgtgaatagtgccacaataaacatatgtgtgcatgtatctttatagcagcatgatttataatcctttgggtatatacccagtaatgggatggctgggtcaaatggtatttctagttctagatccttgaggaatcaccacaatgtcttccacaatggttgaactagctgttcctatttctccacatcctctccagcacctgttgtttcctgactctttaatgattgccattctaactggtgtgagatggtgtctcattgtggttttgatttgcatttctttgatgaccagtgatgatgagcattttttcatgtgtctgttggctgcacaaatgtcttcttttgagaagtgtctgttcatatcctttgcccactttttgatggtttttttttttcttgtaaatttgtttgagttctttgtagattctggatattagccctttgtcagatgagtagattgcaaaaattttctcccatgctgtaggttgcctgttcactctgatggttgtttcttttgttgtgcagaagctctttagtttaattagatcccatttgccaattttggcttttgttgccattgcttttggtgttttaaacatgaagtccttgcccatgcctatgtcctgaatggtattgcctaggttttcttctagggtttttatggttttaggtctaacatgtaagtcttcaatccatcttgaattaatttttgtataagttgtaaggaagggatccagtttcagctttctacatatggctagccagttttcccagcaccatttattaaatagggaatcctttccccatttcttgtttttgtcaggtttgtcaaagatgtgtggtattatttctgagggctctgttctattccattagtctatatctttcttaagccttgttcctgtcctggcattccttaagaatggaggttgcatccagctgcagtgtgggtgcacttgggcttagtgctttttctgagacactgtgttgagcggagatcttagccatgtactgttggtgtgaactctggattccttctggtcattacgtgtcctctggcactgttttccagctgagggctgtgacttcagagccttggccctgtttcatctttttatgtggatgtcctctgaagttttaattgcttacactgtcttcctttttgctccctgttctgtcaccttagaagtggtcgttaaaagctgccattttactcttgaggactggcacaccaaatgagggaacaatgtatgctgctgctgctgctgttgctgttattgttgctgcggttgttgtggttgtgtgagtttaggtggctgtggagaaacgtctttcaagatttagcatctgaaacgagaagtgtgttgaggagatgggattttcatatcgcctgttctatctttgcatgcagtgtaaaaggtcaaagccttgcttcagctctaaaggaccttctttacataatagcaagaattgactctgggcatagcttatgtcccattcccacttttcttgaggattactttaaataggaatacctgtctattatttaaaggtaattttgtcctctttgcgtcttctgagagctagttgcccgtaagatgcctttcaaccttgtacttcaacaaaaatagagcaagtttattggtagtctttatgacacatcccccatggttggatacttgatcctcccccttttaaatctgtcctcaattctttctaaagctatgactttctgatgcaagagttctgctttccctttgtttccaaatatgtatctcttactgatatctgtcttcacttctaagtttcagttttcaattctctttcatttgatcataggcttcttctgtgttttttctaatactatcagtgtactttcaaattttcacttttctccttcaaccatcatgtgaggtaggtagctgttgagattttcattgacgtcaaggccctccacttgcctctttagagacttgcttgctttttgttcacagtacttggtaattatatcacatcccagttcatatgctgcttggactagccctttcatgatagagattcctatgttctaatctattcctaagtgctaagaggacccctgtttctttatgttaaaccttaaaaagcatctctgttggatttggtagttgtatattttgatgttatttctactattatgtttttgaacattttaacaagaagagaaaacctttttttgtccatgcatgtttaagagaccccctcaaaatagactgagtcaaaaatatccctttcagtagtacactttcaaaatgtttgagatgtctctgtgaaagggctaatctggaagtctttgacagtttggaagcctgaagaaatcccccattttcccaaagctgtgtttttgaagactgttcttcaaagagcaagcccaccgttttgctattagtgccaagaaagaacaatgagtagattttctgtgtcacaaagaaaagtagtagacggaagatctgattgccaccatgttgcatttaaaacctcattttctttagagaactgtccacaggactctccaataggcagggatttaagggtgaaacagttcagaaccacatctcccaccatataactcaaagatgacgtttatatatctgggaaccttttaaaaaccatctagatctatgggtaaatttcaaatccacaaagttcaactggatggaaagtttactcaaatgcattctttcgtcccagtttttaagcctaatcctactgcttttaggctgactgaaatttatagaactgaaatcatcattgtatctccccagtgactggtggtgatatttgacttcatatactgagaccaatttttatttaattcacatttttggaagagcttgacctgaaagtcattgccctatgctgaaaagattgaattggttttctcaagtatatatcataaaaacagttgatcctatcgaggtgaggtcatatcaaagtagtacactgaaattgagccctgaagaaaatattttttaaataattttttttttttttttggtagagactggatcttactttatttcctaggctggtcttgaactcctggcttcaagtcatcctcctgctttggcctcccaaaatggtgggattacaggcatgagccacaagccacccctaaaaaatgaatatatttttcagatatcaaggcctagcaattttcctaggtcagcaaatatagtctcttctttctgtacttcacaatgcaacatttgatattgagtagatgttgtagaacattacgttgaagagcccaggttctagaataccaccatatagtttagatcttggctttggtgctcgatcattgtgactttgagaatattgcttaaaattttctttcctcagcttgtctcatttataaaataatataaaagccactctctaccatgtagtgtttttgtgcctaatatatgagtagtatggaattgaatcttaacccactagcatctgtagtatgtgctactgcagtatacgaaaagatgcagtagatttctaaattttggggggaatattgtgttttatgcacatgcgttctataagggaaatttaggaaaccatgtagtgcatgttttcatacactatatttgtactggtatgaagtcacacagacagttggaatactgtcccgaagatatataattgtttgagtcacagaggttcctacgactccattaagacagaaggtatagcctagagttggtgggtctgagacagtgtctccaaagtctgaaggataataactgaatatagactccaaaatttaaggcttcagcatcctcagagtccttgcatttgtgagagctatgtctgtgatgttgccgtttgtcaccaggatactttatgttgtcttttaagtgttaggtgtccagatgcagatcacctgcatcttgcctcatatgtctctctgaatgtaaagattttgcctacatctgatgaaaactgtccactgttcacattatttgtcatatgtatctgcttggagcagagtaagacacttctaagggaacttgacatttcatgacccaggatatcagattcatccttaccactagctactctctgaaatttgggaatttcgttggtcttatggaccacgatcatgagactttttagaaagatgaactaaaaaatcgctattcatgcatccatttattcattcatccacatatccacccatcataaacatttacttcagttacttatccttctgcagaagggagcaagctgaaaacaaagtaattgggggtacatctccaataaccctccttctggaagtggaatgaaactccctccttcccgtcaagtctctttacataagtaaattgtatagaatgaattgtgctcctccccctacccccaaaattcatctgttttgaaggcataacccccctgtacacctgattgtgaccttatttgtaaataaggatattgcagatgtaattacttaaggtgatatcatatagaagtatggtggatccctaatgtcatatgactggtgtccttataaaagggggaaatttggacacaaatagacacacagggaaaacaccatgtgaagactggagttattctgcacaagccaggaaaccaccagaagctaaatagaaggagaccttttcctagtgccttcagagggaacatggccccactgacactttgatctcagacttctagtcttcagaactttgacacaatacatttctcttgtttaactcagtttacgttactgtgttacagcagccctaacaaagtcatggagtaaactctgggattaatccctttccccaacatttcataaactattctttatctacttagcaatgcattttggatattcttctgtgtcagtaaatatgtttctatgttatttctaatagttttaatatatatagttatttcccaaattaaaaaaagttaatccgttcactttgatatacattaatatactaacttgtctctaatttgtattaatagttaaaaattctgcagagtggtggtgtaatctggtttacatttgaagctattgattgtacttgttaactttcataactgctattttatatacttatatttcatgttattataaagttcttaaattggctaatttttaaaaacaggaatgaataacaaagaaataaaatataatcattcctaatggcagttatttttcttatgtattcatgcctagttttcaccaatgtgcatgtattttatctatttctaatatacatatatatgcacacacagacacacacccacaatgttctttaatttgatttattacttaatatattataaatatatttgcttttatagtacctttatggaatatttggaatccccatacaattttccatcaaatatatatgctcaaaatattattgatgtaactactccccattattgaacatttagtttctttttagctttaagctattggaatttgtgctgtagaacctataactatcctaaccataagaaggataggtcaaaggttatgaaactttgttgatcttctgtaattattttcataaggattttccataagcaagatgatagtgaaattgactaatttaggttgacaatttattcttgaaattagcataaaccagcagtatacaaaacagtaatgtagggataagattcaatttaatgctacattttagtaatcagaattctgattttctgaatatattgtgtcctttatcaggtgaatgctttcgctgttgatatgaacctcatctttccccattcctgcaacctaatgctttgtctttaaattctctgtcaattggcactaatttcttttgagacgtgttttggaaacaaataagatttttcttagtttaccaacttaactattttttccttaatctccacttatgataataatcttgagaacaaaagtatttagaaatgccctaggtataaatcccgaagagattgagtataataagccgtccatggtatttacacttggaaagcaaactttgactctttgccctttaccacgtagacttgatgcaaaaatcaatgagatgttctaggtttatgaatttgatttctttttatctttttcacaatgaaggaaaacaaatcaaattaatgttacaagtaaacagatttccgagctttgctacctaatgctgaacatctacgtacttcaaagacaatatagaatctttgagataaaatggcatttttttcccttatgataactgatattcaggattggaaacagtttgcctcaagaaaatgctgctttgcatactataaaatgccggtgattactcaactcttgcagtgttagatctaggagggaactcaagagttattccaatttttttccatgcagactcaataatgacattgagagaataacttttaataatacaggtatctattattaaaatgaaaatggcagaggacaagataatatgccataatctgcttcatcagtgttgtgtgtgtgtgtgtgtgtgtgtgtgtatcagcaaatattttttcagctaactaataggtgatataaaaaattggggttgtaagacctatccatagaaacaatcataaattactagccatagaatttatttgcctccctttggaagtttatttccttttgtgattaataacaaacttgagggtaggtgtatgtggttgaatggtaacaggcacccaaggtttggttacgtgggattgcatcatgttgcttggcaccacccagctgagtctccaaacagctagtttggaggcatgtgtctcgtgggcatggagtgttaatttctcttgcagcaaaacagaaagcggccgactgagagagtggaggcatgggtgtggttgaagagcacacaggagaaaagacggtgggggaatatcatttttttggttctgcttctactccagtactggatgccataagatattgcctactgctatggacattttattttaaaaagtagtaggagtttcagtatgatttattcattgtctatagaaatcctaatgtggattatgttcatacacaatatacagaagtatagatattaaatagtcaatttcataaacataatctttaagtaattgtgagtcaaaaatattcagggtccaattacaaggaaaagtacaattttttaacaatgctttatgtattttatttgtcttgatccaaggtttataaagtagtttaaatcctgtgcttacttaacttttctgtttatttgccaattaatagagaggagataaatgaaaaggatcagataggaagaagggaagcagccaatattgtcaaactaacaatggaaccaattgtacctgtgatgttatattggcgagtacagaaatattgaaaaacatattaggatttcaaagcatctgttttgcatatgagtaaacggagggttatgagatttcttcactcattacatagctggaacttatacccaagtccttatctccaagtctaatctcctatctttcttcagctatcttctgggtcttggggccagatttagggtgtttgaagaattatttgtttgcacccttaaactcatttgaattttgtaaactcttaagtatagtaacttcacattaggtgttgcacttgcacagggcaactttggctaatggttattggaaatgtggagtatgggccttctagggcactttccttagtttttttctttttctggagtgaggtgaggctataaaaaatagacaatattaaagcatatagtcgtttatgtattcaatacttttctatgccaacagatcctctcagtgtactattatgcaccttattttgcaaataagtcaagagaaaaaccgttttttccatattaaggaatcatataggacaggcagggtttatataaaattctgatagcacttagtaaagcttcgttctccctaaagtgggtacaatagaaggtaagctttggaattttaagagtattcactgttcatgacactgtttatcctacatttgtcacatatcattttctcaggatatctgacataacctctccaagatatttggtttaaaattaattggcagtcaatggcaaagggtagagtcacttaaatttgctgaagcaagcacagtagcatctaccagagtatatgtcagattgttctcagaccgccaagggcaaaaatatgtgctgagggaggctgtactggtgccactgtgttggaggccttcttcaactcttaattagcttgctatgagtggagatgccatcttgactggctctctgggaaccattaggcagggccactgaccttggcaactctaatatttatctctgtggaactgagttgtgaaactaaaaggcactgcacaggtgtttccaaatattttaaaccagcaatggagagactattaatttaggccattaaaactaactaccaatgtatagagtgacctggtacaggacactctgcaggtatcaatctacctttgggtcagtagcacagtgccccttgccttctgccaccacattagaggcatcatttttatttttagcctggacataacagctggttaaattatgtgaggagtagctcttcttgataagatcagcaaagatgctagaagtaagactgactgtgaaatagctgcagccaactggcctctcagccatcattcttatctcctggataaataagaagcctgcaattacattttgaaaatctctaatagtcagataggcaaaacaggacttccatggactcaggttgaaaggtttgattgtgagttgtgatttaaggccaaaggaagagaaatagccaagagagaacagtatagataggagacagaatctcagtaatgaactagcaccagaaaatcttctgcaaagaatatacacaagaaataatctccaagacacaggatttaagcttctgcattttctttctattcctaacagtgtgcctagcaaccgctgatatagtacaaattttgctgaatgtcagatcgagagctctggaaggtttatatctgcaggagattaaggtacaaatatttccagattcgtttcagggtggcaagatcaactcacagcatgaggcttctgtcatcatagagatgctttgtggtactttctcttctttcgtaaatgaactggcaaaattgccacttgagtcaaatggaagaaggcaaaatgttgtgttagctgttctggggagtgagtggcatgtttcctgggccagatagtggatccatattcagtaaggggactgactcagtgctctttgtggaactagaagatcagaaaacaactgatcatgcttacgttgtattcatgatggccttgaaaagaaacatttccacccattatgttaccactatattgaacatgcactaatagaatagaagtggaaatcatcagcattaacacagattaattttatgaaaggtcacagccagattgtatacatggacatgccataggatggaccaagataaatctttaccatttatttagttcttcattgctctgggaaacctatattttgtcagttacaggaaatatatagctcaatggctaccattagtttgaaaaataacagaggatatattttggcctgaaaggaacagaggtctaatgttattgcagctgtaataaagaactaagcgcctgaccttatgcttgaaagagttaccaggtgaagacagagctgttcacttaaagcactcagattcagaagcaatccttaaaaacaaaacccagaggaaaaccatttaataaacaaataataaggcatgctggagaggcagttgtgggagtctaagtgtagtcaagtgtttccgtcttagtgcttgttccacttagccagagctctgggtcacctgggatttgggccctgggaggggataacagtgtgtacgggtttagcactggactctgctgtgcattcaacttggagataccataggccaactggagctcacaggcttcacagcttcatcgatttttagcttcagtgaggataatagggagccaaaacaagacaatttcattgctccatctctgctacctcatttctttttcctcagtatgcatttagacgttgcagagagttcatgggacagacaaagaaaaccctttgctgtgttcacaaatggtccaagactgaattaagaatcacaatgatattttctctattagttaatacattatttaactttatattatacattgagtatttaagttgttttaagtgctgttttacttgcatatattaagacaaatattacctggttgatttccacacagtggacttttaaaaaatcattcaatcaagagctatcttggtatgaaggtaaggaagcgacaagcctctgtggtagacattgaacttttcatattttggatatatctgtcctcttttttcctttgagaacacacaagagaatccttattattaatttgttaattcagaaacctttcttgagtaagctacatatttttataaattcacacttacaaatcaagaacctgatactacctgtaatcctaacaaataaaattaaatctttctcagaccccacgtgccaatattcatgattgtcccatgacagcgagtggtgcctttatcttttacaattattcacgcatcaagcttaagtattttggtaaatgatggagacacgctcctcagtgccttagtcctccttggagaacatgggaagaaagattgttcttctgcaatcataagcagactgtggccatccaagaatccaagtatattcttaaacaagcttggtctcaccaaaaatagttgaatagaatattgcccagtcatcaagaaatcagcaaacattttaagcacctttaaagtatgctgtgctaggcattctgatgggatacaaaaaatgtgaggatacattttaattaaataaaaacaatatgagtttctgtcctcaagaaacttataattgggaaaagaaaacaaagtacagtattcaatttcttcctggttcagttttgggagattgtgtgtccggggttttatccatttcttctagattttctagtttgtgtgcattgaagtgttcatggtagtccctgagggttttttgtatttctgtggggtcagtggtaatgtcccctttgtcgtttctaaatgtgtttacttggatctctgctctttttttttttaattagtctagccactagtctatttatcttcttaatattttcaaagaaccaattcctggattcattgatcttttgtgtggtttttcacatctcaatttccttcagttcagctctgattttggttatttcttgtcttctgctagctttgtggttagtttgttctttgttctctatttccagtggttgtgatgttaggttgttaatttgagatctttctgaatttttgatgtgggtgtttagtgctgtaaacttttctcttaacactctcttagctgtgtgccagagattgcgttatgttgtatctttgttcttattagtttcaaagaatttcttgatttctgccttaatttcattatctacccaaaagtcttttaagagcatgttgtttaatttgcaggtaattgtatgggtttgagagattttcttaggattgatttctatttttgttgtgctatagctgttgctacaattttgagttttttgcatttgcctgaggattgttttatgtccaattgtgtggtcaaatttagagtatgtgtcatgtggagatgggaatatgtactctgttgttttgggttggagagttctgtagatgtcttttgggtccatttggtcaagtgttgggatcaggtcctgaatatttttgttaattttctaccgcaattatctgtctaatgctgtcagtcgggtgttgaagtctcccactattattgtgtgtaaatataagtctcttcataggtctctgagaacttgctttatgaatctagctgcccttgtcttggttgcatatatatttagggtagttagcttcacttattgaattgaaccctttactgttatgtaatgcctttttttttttttatccttttcatctttgctggtataaagtctgttttgtctgaaatcacgatagcaacttctccttttttttctgttttccatttgcttggtagatattcttccattcctttatcttgagcctgtgagtgttatcgcatgtgaggtaggcctctcttgaagacagcatatcattgggtcttgctttgttatccaccttgccactctgtgccttttaattccaaggacatgaacagacacttttcaaaagaagacatacagtatgcagctaacaaccttatgaaaaaatgctcaacatcactaatcattagattaatgcaaatcaaaaccacaatgagataccatctcacaccactcaaaatagctattatgaaaaagtcaaaaaataacagatgctagcaaggttgcaggaaaaaagggaatgcttatacactgctggtgggaatgtaaagtagttcagccattatggaaagcaatgtggtgatttgtcaaagaacttaaaacagaattagcatttgactcagcagtcccattacaggttatatacccaaatgaatataaatcattctgccctaaatacacattcactgcagcactattcacaatagcaaagatgtagaatcaacctaaatgcctatcaacagtagactggataaagaaagtttggtacatatatacaatagaatactatgcagccaaaaaaaaaaaaagaacaagataatgtcctttgcagcaacatggatggagctggaggccatcatcctaatcaaactaattgcaggaacagaaaactgagtactgcatattgttacttataagtgaacacatggacacaaagaggggaagaataggcactggggcctccttgagggtggcgagtgtgacgaggtggaaaatcagaaaaaatatttggtactttcttattatatgcatgatgaaataatctgtacaccaaacctccatgacacacagtttacctatgtaacatgtttgttaacctgcacatgtactcctgaaccaaaaatgaaaatttaaaaaaaacaaaatatgaacaaagtcccaatgtaagagacaaatatcagttcaattaagtacagatattgattaaattggtagcaggaataataaatacttcagcagagtagaagaagaagaaatggccatgggctatcctggcctttaagataaatggaagaaaatgaatatgagcagtatcctgaaggattggtaagatttacaccaatttcattccgagcggatgttctagcatgcacaaaagtaaaagcaggaaaatgtaaaatcattaggtatgatgatgatagtagttaacttttattgagtacttgagagatcccacgtaatattgattaatctgcaccagaacatctaagacaaatttaagacatgccagtggaaaagcttagccacagattcgatgtaggtgataaaaataaagggaatgagaaagctaaacattgggagaaattagcaaaaactccaggtcttcaagactgggtagctggaagaacatggtatagatctactaatacgagtgtcttttgacagacctggtttacagagaagagatcagggttttgtatgatatttatttatttatttatttatttatttatttatttatttatttattttgagatgggatctcattcttgtctctcaggctggagtgcaatggcacgatctctgcacactgcaacctctgtcccctgcattcaagcgattctttggccacagcctccctctagtagctgggattataagtgctcaccaccatgcccagctaatttttgtatttttagtaaagatggggtttcgccatgttggccagtctggtctcaaactcctgacctcaggtgatctgcctacctcggccttccaaatactggaattgcaggcgtgagccatcatgcctggccatgagataatttttaatgaatttaatggaatgattcaagaagaaatattcagtaaacatttagaaagttgggaactgggattccagagaggctcaactggaaaaacacttaatagtcaaatgcctagggaaggtagcttcattcaccagaatgaaaccaaaaattgtgaacctcctttagaagttttacatctagagaaccatgaaacaaagtgaattttcatttatctttaagtccaaagagaacttaataaccctcatgtttctcatgatactgtccaaaatccacagatccccaggaaattatttcttgttttcacagagacatgcgtattaaagctaactgaagaaggcaaaaaggaaaacaaaatgactgtgaacagactaggtgtatctgttctgttcatatcctttgcccactttttgatgaggttgtttgttttattcttgtaaatttgtttaagttcctggtagattctggatattatccctttctcagatagattattagccctttgtcagatggatagattgcaaaaaattttctcccattctgtaggttgcctgttcaccttgatgatagtttcattgctgtgcggaagctctttactgtaattagatcccatttgtctattttggcttttgttgccattgcttttggtgttttagtcatgaagtgtttgcccatgcctatctcctcaatggtattgcctaggttttcttctagggtttttatggttttaggtcttacatttaagtctttaatttatctcaagttaatttttgtataaggtataaggaaagggtccagtttcagttttctgcatatggctagccagttttcccaataccatttattaaatagggaatcctttccccattggttgtttttgtcaggttcttcaaagatcacatggttgtagatgtgtggtattatttctgaggcctctgttccattccattggtctatatatcctttttgttaccagtaccatgctgttttgtttactgtagacttgtagtatactttgaagtcaggtagcatgatacctccagctttgttcattttgcttaggattgtcttggttatatgggctctttttttggttccatatgaaatttgaagtagttttttctaattttgtgaagaaagtcaatggtagcttgatggggatagcattgagtctataaattactttgggcagtatggccattttcatgatattgattcttcctatccatgagcatggaatgtttttccttttgtttgcgtcgtctcttatttctttgagcagcggtttgtagttctccttgaagaggtcctttgcatcccttgtaaggtgtattcctaggtattttattctcttcgtagccattgtgaatgggagttaactcatgatttggctctctgtttgtctatttttggtgtttaggaatgcttgtgattttgcacatcgattttgtatcctgtgactttgctgaagttgctgatcagcttaaggagatttggagctgagacgttggggtttctaaatatacaatcatgtcgggttttctaaatatacaatcatgtcatctgcaaacagagacaatttgacttcctgtcttcctatttgaatactctttatttctttctcttgcctgattgccctggccagaacttccaataccatgttgaataggagtggtaagagaggcatccttgtcttgtgctggttttcaaagggaatgcttccagcttttgcccattcagtatggtattgcctgtgggtttgtcataaatagctcttattattttgagatatgttccatcaatacctactttattgagagtttttagcatgaagaggtgttgaattttatcgagaacttttctgcatctattgagataatcaggtggtttttgtctttgcttctgtttaagtggtggattacattgattgattagcatatgttgaaccaaccttgcatcccaaggatgaagccgacttgatcatggtggataagctttttgatgtactgctgaattccttttgccagtattttattgaggattttcacatcggtgttcagcagggatattggcctgaaattttcttttttgtgtttgtctctgccaggttttggtatcaggatgatgcaggcctcataaaatgagttagggaggagtccttctttttctgttgtttggaatagtttcagaaagaatggtactagctcctctttgtacctctggtagaattcagctgtgaatccatctggtcctgggcttcttttggttggtaggctattaattactgcttcaatttcagaacttgttattggtctactcagggattcaacttcttcctggtttagtcttgggagggtgtatgtatccagcaattcatccatttcttctagattttccagtttatttgcgtagaggtgtttatactattctctaatggtagtttatatttctgcggtgtcagtgtttacatccccttggtcattttttattgtgcctatttgattcttctctcttttcttcttattagtctggctagtagtttatctattttgtcaatcttttcaaaaaaccagttcctggagtcattgattttttgaagggtttttcatgtatctatctttttcagttctgctctgatcttaggtataccttgtcttctgctagcttttgaatttgtttgctcttgcttctctagttcttttaattttgatattaggtgaacagacacttctcaaaaggagacatttatgcggccaacaaacatatgaaaaaaatctcatcatcactggtcattagagaaatgcaaatcaaaaccacagtgagataccatctcacaccagttagaatggtgatcattaaaaagtcaggaaacagcagatgctggagaggatgcagagaaataggaatgcttttacactgttggtgggagtgcaaactagttcaaccattgtggaagacagtgtggcgattcctcaaggatctagaactagaaataccatttgacccagcaaccccattactgggtatatacccaaaggattataaaccattctactataaagacacatccacatgtatgcttattgcagcactattcacaatagcaaagacttggaaccaacccaaatgtctatcattgatagactggataaagaaaatgtggcacatatataccatggaatactacgtagccataaaaaaggatgagcgtatgtcctttgcagggacatggatgaagctggaaaccatcattctcagccaactaacacaagaacagaaaaccaaacaccacatgttatctctcataagtgggagttgaacaatgagaacccatggacacagggaggggaacatcatacaccggggcctgtcgggggagtggggaagctagtggagggatagcattaggagaaatacctaatgtagatgacaggttgatgagtgcagcaaaccatcatggcacgtgtatacctatgtaacaaacctgcacgttctgcacatgtatcccagaacttaaaatataataaaaaaaaaatgccaggcgtaaagcaagcagaatctgtcagctccctttcattttagaggtctgtggagcatgttgtacaggtttgcattaattccttcagaaccagagaaaggtatcacttaatggaaaacattactgattgagaaatggtatggtttttttgaggtctaatgcaatattttgaatagagaagaatgtcagctcaaaatctaaaatgttatatgaatgtcaggagaagaaaagtggctgtatatgtttgtatatcatgtgtgtacttgagtgtatgtaggcctacacatgcacacacaaatacacacaagattttcttacgtttatccacatgataatggatcaagaccgtttgtgatggccaaagatgcacaaatttatatgaacacctaaattatgttaggatgggagtgaatggaatgattttcatcaccttaatactttgtaatgatcatgaaaggatttttgaaaaaaagaaaaagccctaatgatttttgaaaataataatagcagagggaatcccatgcaaaatcagtttgttaggcatgtgaagattttaagtaatgcagaaaagtaaaaaaaataccttccctaatggtgatgtacagaaacatgtttatcatcaatgcttttataacttttctctcatctcagtttctgttagagaattatgcataatggattgtgtatttaacaggaattcctcgattgcaatggctttttaaaggtttttttctttagttattaatagaatctttcatttacagcctaaatattgctgtcatcttagagaaacagtgaagtatcagagaggaaataaaatgggataaaatggatattcagaatgtcttgctacctgaccgttacttaaaacaagataccttttctttcttttcatgaaaacaaaactatttgtcttcactatccactctgttaaggaaaataattttctcaatatataaagtgaggcatagagcatacttaaggtaaactaaatcttaagataagtgaggccagagtaaaggagcaccaagcctcacttaaatgggttcatagatctaggctgcagtctgttactgttgaaacacatgatacttttacaaacataacaaaacaaaaaacaagaacattcaggtgtttcagtagaaaccgacagaaaagcgttttaggaatgctgtagattagggaaaattccagagagctcacagaacaacaacttcacttcttttgacttttaaagaaaaggtaaaagaataaattctggaaaatacagataccaccagaaacatttgtctgcccttgtaaattagggaatataggtttggtacctacagagtacaagacaaatgctcatcatgttgtgggggaagcaaaatttaaaaacatgtggactctacctaacctcagagagcttgcatgctaattaaggaattaatatgcaattataaattggcatttgacaagtagcactggaaaggcacagaaaaggtgatttattattcagagaagtggtaactttgatctgtggacatctagaaaagttatctctttggaaggtgagctgggtatcaaagagaggagactttattttaaaaggcaggtatggggtggagaaaactgtcaaaacaaagctatgcaggcagtataatattgcagcaagctgctgaatggaaaaaccaatttgatggaacatggttggatgtcagggaaattgggagatgtgttcagaagagtcagtgaaatttgactgcagatggtctatgaggaaggtgacgtgctacggcatggcgaagtgtgttgagtaggcacccggagactagagtttctgttagtctctgtcactcactcactgtgtgtacttgaggaccatttgacctccttggcaagtacacgtcttacctggaaaacgacggtgtctagttggagaccagtgtatcaactcacggtgattccatacagcaaatttttcttccaggtttggggtagatcaccaggttattgattaaacaccacacaaagtaattggcttgagtttaggaaccatgttttgaaaaaactgttatatctttaaagagaagaatcatcctcagcctggggagatactcacattatttcagagacacaagaactgaaacctcccatgagaatggtggactgggtttgtatgttccaactagcactcattccggggcatgtgctatctacagcgttctgtctctataggtatgttttgatgtgcttgtttttatcctttttcacagcacatatagtggaattcatttaaattaatatgtaagatgcatttgggcctttcatctcaagaacaagaatatggaaaccaaagttatttaaaactctagtcaaaggactgccttgaaataagtatcaaaactccaatatcaactttggcttcaaaaaggaacctaaaggcatttaacagtgtgtcctaagggatcaaatgtcaaatatgatggttactaacacacaggaagaaaaggaccagagctagaaaccagcagtaatatcttccagtatttttgggggagatggaagctgaaaaggatgaggaagagaaaaggatatgaacactgggtttcaaactaactttgctgaattatggaaagagaagaaatatttatttctgctgatatatcatgaaaagttactattaactgaattatttcttttcatttcactcttttctattaaactaatgatcaaacaggttggttctagccacttagaaaatgatgttgaatatgtcttgaaccaaaccagtagacgagttagtttaactgtatgaattaacaactaaagaaacacaaaatgctcatttttaccaggagttaaagctatgtgttttctgtaactaccaaactggaataaaaaagttatctcaataatcggtgtactgtatatgaattgatatctcatttaaattaatctacatcacaaaccttgttcagctttactcctgtctggccaaaattaatctttataatgaagtaccttaggtattttaggataccagtatgtattcaagtgagcgaataaaaattcagttgtctttgctaaaatttctggcatgtttagtgttttaataagttatctatccaaataggtattttaaggtattagtttcagacttccttttggtaaatgtgtttatatttgtaagttttaactggctagttttataacatatattaatttctaaacaggatttagagcaaaaaaaaacccaaacatactttgcttagtccacatttcactttacaaagtaccactggtcagctcagtgatactttctccagtttgtgggtcatttcatcctgcatttgtacaatgattttgagtaacacatcagtagtgaggccagctgattttgttatacccagagaagacttttaaattaaagcttgagaacagaaaaaaaaattactgaaaattgaggatcagcaaacttttcttgtaagtgggtaggtagtaaatatatatattttttattttataggcgatatgatttttgtcacactacttgcctctgctatagtatcacaaaagcagtcataggcaatgccaaaatgagcaagcattgatgtgttccaatattacttacaaaaatagatgttagactttcggcctttgggtctgggatttggcatttaggccataatttgtaaggaatttggccaaagctcatagtttcctagtcgttgctaaacatgacaggggccccaaatgaggtcccaaaatgagttctgaagaacgtttgtcccatgggattttcatggatgaaaaagtaaatctaggaaatgctgcacagaatgcctttcttcttacacactgaaattcaatgtcatcttattaaaggctataagacatcttacaataaagtgatctgtctctgttggctaactcagttccccagaacacatgtgaccttgaaattctttttgtcatagataatttgagtatctgtgattcagaaacaagtttccaaactgatcatttggatatctatatagattgtcatatgcatatctttattgaaatatctttttaaatccgagtcaacttcgtgagtcacttatccacaaaggtaaccaggaaaaatactaaccttcttaagtggttctggataatttcctgattagtcccttcttaggttctaacacattagctcctgctgacaatttgagccgttggccttattctgctttttcctcggtaattaaatccattgtagtttaaatcagttcaacatatatttaccatgtacgatattttccaagcacaccgattaatgaatgagagagaccgtgtctctccctttagggcatggatagtagcaaaggcataaagacaaaggttagaatattatgtgataacttctctaataagagaaatcctgaatgctgtcaaagcacatatgagaagtactaaactgttattatgaaatcagagaaagcttttagcctggagttcatctaagctacaaatttgaagctaatcacagaagggaagagagaggggaacagcaggtacaaaggtaaggagacaagattctctgatgtatcaaggcagtgcatagtacaactctaatatagatttatgctgcagagatgggtgagagttggattaagcaggtttttactgactttgtgaaagtatgtaaggtaggtggaaagttggaggcttgatcagagttgtactatggtaatatagctgtggctggaacgtggagaatggcctggaggggcacactgctcagaagtgagaatttctgaagctgttatgaagctttcccagggaatctgccatgggtaacctattaccccaggttcatcccttagacagataaggtgctgtcaagactcctaccttatgacaagaaaccaagagctacgtaatgtttttttccctgaaaccatctgtttgctagtgtaaacattaaactgtctttccatttgggggttactggaaatatcataaaaagggaataattttagactttttttaaaaacttgaaaggaggctttattatgtatttatagcaaaacaaaaattggcaccaagaggctagcctgagttttatacctgaaggaaatgtggaggcaaacctgggcattttccttgacaacagcaattaaccaagaagagcctcaccttaacgtctgttttaagacagcagaactggtcggcatatgaatatacaaacgtttaattacacaccctgcctgtccttgtgaacctctgtggtttacttacaaacgcatgagttatttcacgaagttatcctcaatcaggatgcagcatagtgttgtgtttactacatatgaaacatgcacaccttatccagtctgacacactgaagcacttaaaaggatgtgcagtaggtttttttataaacaagtagggtttttataaaccattttcttccacacaacaaattatactgttaacagctcggccctggtaagttttatatatgtgtgcatatataaattttatatatgtgtacctacaaacacacatacacacacaaacatataaaaatcacattttatatatgtgtgtgtatatgtatataatacatatattatttggaagtgtgatttctgtatttttcctgtattctaaccatatgaggaatgtctactcaacattgcttagaaacacaagttctaaggtccaaacttaagggtgtgtgtagtttagttagtggctgctatggttgttggtggagagtcagatgttgaaaagaaatggaacaaagttttttctaaacttgaaaatgctgtcttgaaatttgcagctaagatgtagtaaaagaggggctggtaggcaagaaaagaaaaactgtatgtaggcatggatcttaaacaaatcatgaaattgaattttcctaaagcaacttaaactatttatgattttctttgtcctttgccagatctctgaaatagcgtcagtctcaaaattcatgttatcactaattaggattctatcctcagattttttttgcagatgattcaactatttcttagtttccacagataactaaaattactacagtttctcctaccaacaataggcctagactgctaatccaaggaggaaatttgatgtcagaaaaagacacaaacaaagcaaaaatgcagtgttaacagttattcccacttttatctttctttacatagatctcacatcgcattgcaaggagcttacgctagtagtaaataagaaatttaggggaaacctgcatgctgcatttttagcatacaagaagtacaaaattctggctttatttttttcttcattaatatgcatggtaggccaggcatggtggctcacgcctgtaatcccagcactttgggaggccgaggcgggcagatcacgaggtcaggagatcgagaccatcctggctaacacggtgaaaccccatctctactaaaaatacaaaacaaattagctgggcgtggtggcgggcgcctgtagttccagctactcaggaagctgaggcaggagaatggcgtgaacctgggaggcggagcttgcagtgagctgagattccaccactgcactccagcctgggcaacactgcactccagcctgggcaacagagcaagattctgtctcaaaaaaaaaaaaaaaaatgcatggtaatcttggttcttttcatacctacgtttgaccgttcagcagtctaattttaattaaatcataacaaagtaacaacattgactatattgattgcatcttgggaattcagaatttattttttcacataatttttcctatgactagctggtcttctgtaggcaaacttttatgatccttgaactttttctggaaatgatgcagcaaactataaatataaaatctgcaatggtatactgtatgtacatatctttcaaggaggatagctccactgatgtaaaaacaaaaagatattaaaaactctgattttcaagctagaaaattatttatgcaccattggctttattttaaaatacatacttgcagaaaagttgcaaaaatgtcagcgtttccatacgcccatcactctgattctactaatgttaatattgtacgtaagtatagtatgatcaccaaaccagaaaactgacattggtataacactgttaactaaacaacagaccttattaggggtttaccagtttttccataatgtccaggctgcaatccacaatcttgcattgtttatagcattcatttcttcttactcttcttgagtctgtgccagttcctgagccttcgcctgccttttgtgatcctgacacttttgaaaactactagtcaatcttgttgtagaatattactcaattttctgatgttccctcctttttttttattgatgtcatgcattgttggcaaaataccatagaagagtattatgtccctctcagtgcaccctatcaaagggcacacgaggccagtatgtcttatcactagtgatactaattttgactatttggttaatatggagtctactgagttttcccagcatgatattagtgttttcccacattagctttagacaaagacacataaattcttaatttcctaaatatgatatactcactatactcttttatgcctcagtttccctgcctaaaaattattatactgcaaccctaaccctcatctcaaccagtgtagtaagaattaatgtgctgtcctttggagattcttggataaaactcactgtataactgcaaatgatcactctatctcattttaaagaagaacataaatagaatggttaaaagtagattggcagcatgtactcatttcacacccagaactacagagacatctgttatatatgtgacaggccaggcctgaaatctggttctctgagaaccagttagtgtttgcccgatttggcctaagtcagcctgattaaacaaagaacatatttatcacttgctacctaacaggctattacactaactagatggataaccacccattgataaggacaataaataactttttaaaaactgtcacattcagggtttctgctgttcatataagagggaaaaaagtcccttgacatactaaggattctggatccatgtgctgtaattctgtcatattagtttgtatctgataatgaagtaccccaccattgcagagaatggcaaacttcgcaaagtgatttactggctttctactctatttttatttttgaatgtcagtactatcagccctgacacaatacactgggaggaaattggccacttacaggtctagagggaagtaggtagggaaaggtatactaaagaaataagggactcacataatcctccaagccccgctttcctctttgacaaatggaaataatcatatacctgcctcctcaagttattgtaagcatttggtaatctgtccaaaacctttgtattgtaactgacccatagtaagtactcaagaaaaaaagaaaaaggttgtcatttttatcactttatcatctttcatacctgagacccagatttgggtgcaaaagacaagaaaatggaggtgaggctctcataaatagtgtggtttaatttgcagaaggcttctggaaaatgattttataccaaataagaattcaatagcatttgtcaaatggggtggaaatatcccaccatctgcatgtagtcatgaactaaagcatgatgatactgaggtgtacttctgctctttgagagtatgtgttcataggcaaataaacctagaaaatgaagaagaatgcaagctccatgatagcaggactgaactttaccgtgatacccagtgcttgctggtacagtgtctgacatattgcatgtgttcaacgaatattttcagatgaatgttctaatagttagctataaatacataatggcacaggatcttgaatacacagtttatttaccattacatgagatgggagatcccatattatagtttagctaaaaagtagggggatttcctgtcccaacctccacttatattgttattattattattctttttctttttcttttttttttttaagacagggtttcactcccatcacccaggctacagtgcagtggtgcaatcatggctcactgcagcctcgatttcccaggctcaggtgattctcccacctcagcctcctgagtagctgggactacaggagtgcaccatcacacccagctaactttttgtatttttagtagatatggggtttcaccatgttgctcaggctggtctcgaatttctgggctcaagtaatctgcctgccttggcttcccaaaatttggggattacaaatgtgagccaccatgcctggcccactccacttattttaagagaatgacttctgacttccttctaagtaaaacaacacttatattatgttccttttgcattatggtggtaaccattttacttgtgttatctcatatacttctctacaaacttctgaagtaggctcagtatctccgttttatggacacaaaactggaggatcagaaataacttgcctaaaacaatacaagtccaagacttgaacttaagtctatctacaaagaccatttatgttcttgactgatactgttgcatttgtgcactgttgcagccctcttagagtattatattatcttcccccagtagagtaaaataatctccatgagggaagaccctgtcttattcattgctgtatcgtactgcacgtcagttactagatgttcagtcactaatttgtaagtaaaggatagagtgccgtagtagattttatttaacaccctactttggtatagcctattacaacttcagtttttatgtttgaaatcttatttctgcttctgattaagcagacatagactcccttttaggctaccagttatctgattttctgatgtggctgtccgagcaatcagcaagctgtgcgtaatgatggacatactagtaagcttacttccccactaagtgtatccaagtaaaagccctgaaagtcacacggttcttgccacttttaatctgacacctaatatattaggtattagagtgttttgtgcttacctttagctcttctttagtttaggtgattaaaaaatgcctgttgctgtctgtatgtgcagcatgcttcattaacagtcatttatttgggaggttagcagaattggcactctgcagcacaccagcgagcagaaggaaaacaaacgtgagatgattgctaagaaatccttctttcctgctctggtgatagaagctttaagagtttgcaaagtttacttcccagtacccagaaagcatgggaaagagcagggtttctggggattgcaatttcccccaagtcccttgcatccgctctcctccagtgctcagtgggaaatccaaggggtcatggatttccccctttggcacggtgtgctccctgtatttgtggtctcccagaaccagatccttccactgcttgcccctcttgttttttccagcaagtttgccgactcaaactttttctagcagaatccaattatatggattttctctcatattcctttcaacaaccctgtattttcactgtcactttatgaaagaggaaagtgaggctaacagaggttaaatgacttgcccaagaacaacagctaaatggtagagctgggatttaaacctggcttgtgtgattctaaagccaatgatctcattgccatagggaagcaaaggaatttttattttacttgaaacctgtattgattttgtcatgtgtacttgaaatgccatgctgagaggattctggggctgcccttgggctaagcagcaaagagtgccataatcaattagcattgctttccataggagtgggacagaggagtggaggtgccatgtattttcctgtcttgaactatgatctacttttgttcttgattttattgtaataagactgtaataacacgggaatgacattctaaaggaaggatgaagtatctgaggggcaatctaaatgcaagatgaaaataccacatattttatatataaactacaattgcctgctgttctaataataaggctacatatacctatttgggagaaattcaacagagtgtttaaatatccacaatcttaagtcaaacttcataatctcaacttttattttaaattcagggggtacttgtgtgggtttgttacataggtatattgtgtgatgctgaaattaggaggacaaatgaccctatcacccaagcagtgagcatagtacccaataagcagttttcagcccttcctcccctccttctctctttgttctactagtccccagggtctactgttcccatctttatgtccctggatatgcaatatttagctcccacttgtaagtgagatcacccagtatttgtttcctgttcctgcattaatttgtttagtataatggcctccagctgcatccatcttcctgcaaagaacatcatttcattcattttcattgttgcatagtattccgtggtgtgtatgcaccaaattttctttaatccaccatcgatgggcacgtaggttgattctatgaccatgaatagtgctgtgacaaacatacaagtgcatgtgtctttttttttttaattatttcttttcttttttttccttttcttgtttttgagacagggtcttacactgtcacccatgctggagtgcagtggcacgatcttggctcactgcagactccaaatattgagctcaaacaatcctcccacctcagcctcacaagtaactggggctaaaggcaggagccaccacggctggctaacttttaaattttttttttgtagagatggtatccccctgtgttgccctggctggtctcgaagtcctggactgaaacagtcctcctgcctcagcttcccaaagtgctgggattataggtgtgagccactgtgcccagcccaatttatttttctctgggtatatacccagtaatggaatttctgggtcaaatggtagttctgttttaaattctttaagaaatctccaaactgctttccacagtggctgaactaatttacattcccaccaaaggtttatgagcattctcaggattcattttgggagtgatagaaatattctacatcatgatggtgatggtggttgtatgactgtataagtttttgaaatctcatcaaactatacataaaaagaacgcatgtcagtgcataaaatatacaataaacagggaaaatcagagaaagttctatctattacttattaatttcaacttagttaacccataaaattaaaatcatattgttgtttaccttcaaggtttttttaaagattatatgagttaacaaataatacagaaactactatatagtaaatgctgtttaaatggtatctattatttatcatttcaccagttgttttgtactatattctaccattacgttatctccaacattgtttgccagtttaatcacatacccttttatgttgctgatttactacattgtactgtatactctcacaaatacataagcttcatatgtatggataattgtgagaaaaatcatagctttgaatacatggctcttctgtgtttaactaaacaatgttagaagactagaaccattcatgtctgtttttcaactgaattgctgaagtgttaagtatctatatgtccaaataaataatacttattaaaaatgatggactgtaaggtgtgtttaaaaatattgaaagcattagctatgatagaatgtttaggatgaatttgtggtatatacttagaaacctgttattaaagaggaaataacagtaactcagaaaaaacaagtactataaaaaaaaaaagaaaagcagtatactctcaagctcagctaacaaattaccaaattatgtgctataactaagtttagacaacagtgaagcaaggtatgtttgtatttgtgtattcctgtctgtcattgggaatgattaagagagttgaatatcatcattcataaaagaacttagtacatatgacaaaaaaatcaagaaatagtagtataagcatgttattttttcaaattatcattgttgaactacttaacagaaaagcagtttgttgcccctggacaatatttacctatggggactaacagctagtatttaagctatgttcaagcattcctttaataaaagtaaaagttaaataaaactttaaaaaattacaataagtgattacttagtgaaggctgtggatagtgaatgtggacttgtggcttggagttaaattttcagtaacagtttaatacatagaatttaaaagcaatatatctaaaacaattttaatggatgggaagatgatataatccgaaaaattgttacaagcctcaaatggctctagggatgacaaagacatagtctttacttcatttaactaattaaatatttttggcatatataaccttcttcttatagaataatgtaattcaaagtttcaagaatccttaaaaacaatctggcccagtcccgtcttctattcatgaggaaacttgtccagcaagcaaataacagcactgagcctggaacgcagttattctgaatcttatcccagtgatcttttgaaatatcactgtgattattgaggttacttccgttttttgaagagggtcttctcggtagcaaaatataaaggtccaacatcaaaggtagaataaggttttctataaggggaaagtatattttgagaaatccgtagtgggtttatactttaagaaatttcaatgaaagacttttccaaattaatccgtataactgtggactctcgggctatggaagacatccttcagtaagtgaaatgatgatacattagctacctggcttttatttcagaggatttctgcctaatgtactcatatttatggttagaatcttcacaagtggaaagtcttttaaaatggggagcaactgtgtaccttagctgaccctccatcattcctcaaggtcctctttaatgtggtattatgatattatgatggaaacggtgtctaaatcaaccattgggtaggtgagtatggtctaaataagggattccatcctatacatgtctgcctcttgtttaatagatgtagcttcccgaatatatcatccaggtcccttatgtcttcccctcttttgcactgttctattcatattttcagatgcttgggacaaataatctaatgataaaaaccaattaacacatattttctcatcattcctagcagactacttactgcaatctccagtcaagtttgaaagacatcacctataggaatgaaaatctgtttttactggtagatagagtataaagctggttaaaggagaaaatccagcaagttatttgattgactgatgtgataggaattttcattatccaagaagaacctataggctagctactgtaatcacaggacatacagatgacctgaactactcatttgacatataaactatatcttgtatggtcaataatctttcctatccaattgagctgtagtgtccttgtgggcggagaccttgacccaaaactcttcatattttgcattttaccaattgaatcatggacattcaacaaatatctattgactgattgaacattaagattttactgtatgccattttcctttaaaattattggcatattgctttctgaggaagcctatttaatctcttgctttcatttctgtttcccgcttcctcgccattgtgattgactgcacccctcattagctaattgtagagttaggaaactctcaactctacagatgggaactgtggatgatcctttttaaaaatctctgccttcagaatggtagcactctaaataataactagcaagaaagcaaatgtttatgttgttcttacacttaggaggaaagaaacttattcacagttatgctatcacaaaagacttctgaattaacactagtgaaacgtagccttccgacaaagtctcagctctgaaacctgtgctatcctttacattatgagtattacagattctgcaccttggcttactggcacctggcttcacttctgcagaaggacaacatgaaaagccaagttagagagaaaggagtcaccatcaggatgttatctcacacttgaaaagacacaatacttttagaagagttcattacctttagaaactagttcagtatttgaagtatgaagacatagatttaaatactggctctattgatttctagatatttaaccttggacgagtttcatagcctctcatattctaattgccaaagctctaattttatagaggatgatgatgcctgactcccagccatgttataaggattaaatgagaagtgaatgtaagatcacgtggcaggtccacaagagatgttagctgcctttattctttcatttacatactagctgttgattggctgcctgctctggtggttcactattctatgtgcctctaaaatgtcaatcaagaatacaaagattcctaccttcataaagttaaaaatctatttggtgggggccaggaggcagaatttgaatccaagtttaaataaacgatgatagttaatgctcacatacaaaacaagccagtggaccttcacagcacacttgtaagaaagatagggcttctggcatgatccctaacctacaagcaagcaaacatgtttacagagattaagtgtctttcccaaagtgaggtaatttgtagtaaatccaggaagaactcagtgtgcgtgaatccgtgttttcccactctgtcttgctgctatgaggctttgaaaaacatactctgttggaagtattcttagtaattagagatgtagtcaacttgctaaccagaggagaaaagcaaaaaaggtaaaatagatattatgtccttcaggggattgcattttaagcagatcttcatacaggaaaataaaatctttttaggtctttcccttcttgaaagtcattctcaccctcctcgtagacttcagaatcaagtccagaattttttttttttttctttttttcagacggagtcttgctcattgtccaggctggagtgcagtgatgcacgatctcggctcactgcaacctccgcctcctgggttcaagccattctcctgcctcagcctccctagtagctgggactacaggcatgtgccaccacacccaactaattttttctatttttagtagagatggggttttgccgtgttagccaggatggtcttgatctcatgacttcgtgatccacccacctcggcctcccaaagtgctgggattacaggcatgagccaccgtgcctggcctcaagtccagaatctttaatatacgttcaaagatgattggagaccaggctcttgatttaccttccagcctctttccccctcagcctataactcccaaactcaggctgcgctgtgctgtctttaacaaagatagctatgacgtttcaactttgtgccagtacctaagctcagtgctttccatgcattctcactaatccttaccataagtttggcagatagatatcttgctgctcttttatagatggaccacacagctggagagtgggaagtctaggaatagagcacaagttagattctgcagtctacgcttttcattttcttgcactgctgtaacttaaaggttctcacagcttcttgccagtttgttttccttgtcacttggctcagaatggccttcctccctcttatttatcctttaagaatcagttcaaaatggtagcccctttgaggagctttcttgaaactcctgccctaccctacctcccagctcagttcagtgataatcttttgcttccttaacatcttgttcttaataaacttactgcacacattgcaccgaattataatgactggtttattagcacctcctgctaagtaaactgtgagctccttgaggacaagacccgcacctccctaacctctgcacacccagcacctagcaccgtgcctgccacatggtaaacacgattactttttttgttgagctgaattagtactgtttggataccagcaacattttaattcagcagagtgttcaaaacaaataaatacatgaccaggccctgcatgtagattcttggaaaccaggactcttaagggaaaactgattcatgcttttgttttcagcactttgtactgaggtcttcagtgtcactgttagtatgagaattgtttgaagggttgagggaagttttgttctgtgcaagaatgtgaaaaaaaaaaaaaaaaaaaaaaaccaccctgtacaattctcagttattcatctcctcctggctcaatgagagaaagcaatcgaggcctgttttattgtgtagcttccttcttaggatttacgagtctcattcttgggcaggatctcaaaatgagtgctgagtacactacctttgctacagccactgttggataagccagagagagctcacagctgcaggggagatctattgccaccataactcttggctcatcctgcagctttctttctgactctgacagaaaaattgaaattatgaaacttcgtatcctgcaccagagtcccacgtgagattcatgaatcttcagctcccttcagaaaaccggatgctttggttaccactgcccactgacaaattactgtccacgaccccattatttctgattagcaaaggtgaaccttacctacctgaatgtaaataaatgccaataggattcgtgaaattcttcatccttaaaaatctacagcccttaatagaacatgcactgtaaatactatcatatcatgaactaaatctttatcaggtaattggatacatttcctaagctaattttaattgcttccagaaactgcttaacattgtagatcaatcccgaggtccgagatgacatttctctcacaaaattaattattaataccctgatcatttgcttaagacattaatagttttcattgatcagcacgtcctgttgatctaaaatggcctaatcaccatgcatgtcagaagagtatctgaacatatccaattagagatacggccagctttctgccacatcagcagatccgaagttaagagtcccttttgtcttcacaatatattaagtccagctctatcagaaactaagctatttaagggcacaaaagaaaggcgagttctctaatgatgcttgttcattttctgttagctccctggtaaacatacaggctttgcagtgatcacatggtgtaaattaacgctaagagcccattattaagtagcttgtgttggcccatgttttcatgtaagcctgtgtttgctcacagtgtttttcttataagtgggagtaagatgagaaacttcaggttattttcagcttaaaaatattggggctcccacagtgtgtacatatatcaaaatatcacattgtataccataaatatatacaattattatttgtcaatttaaaaataatataaatgtaatatatttttttacatgaaagctaaaataacaagttgagaccacagtaacatctggcaatgtagggtgctgcagagttttcaaagaagtttcatttacttaaccaggagttttcccttgaaacaagattcaaagagaggctaggtggagtggtctacctaggaccacataacaagttcctgccagagttgtaaatagaatgagatctcccggttccataaatttctggtttatttgattgactgatgaataggtagcactctgctcatctttcagaccccaagggaagctcacctcctttgtgaagattgccaaacaaaaagtttcctccttccttgataacgggatatcatattgcaattatatgaaattctcagtaacagcccctactggataaagagactctagaggatagagactgtgccttgttcctcttgatgggcccagtgcttcaccttgtgtctggcaagcagaagatgcttcacatatacattcacacatggcgggctggcaggatgggtgggagaagggatgagtggatgagaggaaccacagttgagagttctgttttactaacttcatgttgcaatccttcagcaccagagggaaatttggctttacttgagtcatacagtgtttaatttttttttttctctgagacagggtctccctctgttgcccaggctggaatgcagtggagtgattatggctcactgcagcctcgaactcctgggttgaagcaatcctcctgtcttagcctcctgagtagcagggactataggcgtgcaccaccatgccaggctgatttttaaaaattttccgtaaaggtgggggtctcgctatgttgcccaggctggtcttgaactcctggcctcaagagatcctcccatcttggccttccaaagttctgggattacaggtgtgaactactgcacctggccttaaaaagtattttgaactaattttcaatacttaaaacttaggagattttcaaaatacagttatattttcaacttttctttgaaaagtcgtagatgcccctgcaaccctggatctgtgttccacattacccatctgcttgagctgaggggcacctgttcccttaagcaaggacatgcctccattcctcagaataacagtgtctgcccacagcttcactcagttactcactttgtagcttttggtaaaggtaatgagtggcctctcttcactgcagaattctcctaattcagtattcttggctaacagaagtattagtgttcctaatcatgttctggatatatccaaatgaacctagtaggcagctactgatagctgtttggatttctctcattagacactggagctgcatacttctgtggcatgttagaagtgaaacacggggcagaggggaaaaattgtttgagttaatggggtagtcaccattttcccacacgatataactccattggaaaaattgggaatttctacctgaggtccaccagtgttaagcctatcttgttctgtggcagttctgtatttgctttttttttaactaattggaaaataaataagaacaggatctggacaaagagagaccttgcaaagcatagtgcattcccctgccttcaggttggttcatgcctaatcagaaactgttcttgtcttcactcagaagccacagggacacttcagctccaatccctgcccaattattatctgcaagaaaaaaataggagtcttattagctttatattcataatttaacatgtccctttcttcccctccaatggtactttcccacaagtgagttttattgatatttgagtaaagataaacttgcagagaccacaaggagaaatattcccaaatctcattgtaatgtctcttctttcccacagattaaaggttatacaaaacttaaaagaagcagcaattctattcgcttgttattggacttgaaactccctttgacctcggaaactgaagatgaggttgccatgggaactgctggtactgcaatcattcattttgtgccttgcaggtagagtgtcattttaaaactttttgatttagaaatgccactgtatttcacactaattcaaaagtgggccttcactttagacggcaatgataaaatcgcaagagtatatgctgctatgactagcatttgctgacactgttgaatataccttcctgatggtcttttagtgactcttttcatggtgttgtatccagagatagacaccgatgtttcacctgtctatctggtccttttagagtcgtttgagccattatttagtttgaaagttgttatttttgctcatcccagtgcccagttgcacagagatattgggcaataaaactgataatatagtctggagtgttgcctactttcatttcagtggatggacgtttatctggatagctctttcagtgtctttgttgataccactccatcttctgatactgactctctttttcatttcaatgtactacagtttagtaggaactagaaagcaaaacacaggaggtttttaccatatactcatggccaactactagaaaagggatttggaaagttcaaacatggctgggcgcagtggctcacaccattaatcccagcactttgggaggctgaggtgggtggatcacccgaggtcagaagttcagaccagcctgagtaacatggcgaaagctcatctctactaaaaatacaaaattagccgggtgcagtggtgcatgcctgtaatcccagctactcggggagctgaggcaggagaattgcttgaacccagaaggcgaaggttgcagtgagccgagatcgcgccattgcactccagcctgggcaacagagtgaggctcggtctcaaaaaaataaaaaaagaaaagaaaagaaaacttcacacatactctctattgctttctccattttctggaagatatgagtctagcagttgacatacatcattcaagtgctggtgcatcagaagtccagcatgcagcgggaattggtttgcagcttgggctgctgtgtatcattccacgcccctttgaaattagtctagttgacttgttttgttattcagagtgtcaagtccaagagggacacctgaatatatttgcatttttacaacatgaagcaaaaatgacttttggatcaccattactttgatgtatgcattcactcaaataatgttactgagtaccgtgtcacaagccagccctgtactgggatctgggaatataatcctgatcaaaacagacatgctactgctctcttagagctctattaactgagtgctgtaacttctgacaacttgttgtagtagattatttgcaattgctataaaatcaaaaataataatggtagtactgacatgtatagatcactcattctatgctaggcaatatgctaagcacgtggtatcctttatccaatttctttcttccacgacccttaagaagtaagcatttatcatttatttcactgtattaactatgaatattaatattatgactgaagcatcaggaagttaagaaactcacccaaattcacaaagccagtaagtggtcgagctaagatgtaaaccgaagccgactatagtcttgcctgttcatagcgtatggtcttttagttgtcttgaggatttggcaagtttatggttgcaaatttagttctgagatttttgttttcattcttcctatgtttttctaaatgtaaaccctcatttacttatacatcttttaatagtctaccttcatgtttcaaacttcttgccttagttgagttcacgtcttccccgctgcatgattgtgaacatcttggcatccctcttagtgatattatttatttcccccatctggtcagagccttcatcttcctcccagcagtatgcccaggctctaatacctcagttgtttttctctgggaccttgaccctcctaagggattcgactgacactttagagttttaacttctcataatgactctggtataaacgtactctttaagccataaagcagtgaattgatttctcatatttggctacagcataatgtttatttaacccaatgtgctaagtaaatatcaagatatgaaagggttaaaaatcaagaaagccactactctcttcagtagtgttttgaaaaacttgggggaattctcacctaaggtgtgtgtgtaactgtatctattttattcacttagctttttatagagaatcagtgtattgattgtttttgtgaggcttttttgtgacctgttttacacggcattaatattctcttaccatatgccttcttcagtgtaggaaagtcaagctttaattaatgtttttgttttcttgctatttgtcttgatttcattaatttacatagcactccactcgctgaattttgattttttaaactgctttaggccaggcatggtgtctcatgcctgtaaccccaacagtttgggaggccgaggtgggtggataacctgaggtcaggagttagagaccagcctgaccaacatgaagaagccccgtctctactaaaaatgtaaaattagcaaggcatggtggtgtatgcctgtaatcccagctacttgggaggctaaggcaggagaatcgcctgaacctgggaggcggaggttgcggtgagccgagatcacgccactgcactccagcctgggcaacaagagtgaaactccatctcaccaaaaacgaaaaacaaaaacaaaacaaaaaactgctcattcttttccttttgtgtatcatccataacttttctatacatcttcaggctgaggtttcttggtgagtttttggtaagggatatgtttacagctgttatgtttaccataattagtgactctcacatatgccttttcctgatctttttcttccccaagtaagacaggatccaaatatacaagcaggctcatcctgcaagggatgcaactgataagatctgttaattatttgagggcatttattagtactttatggtacaatgggaatgttctttttcgccagatgactcagtgtctggcaataattttcaaataaaccaaaactattgatgccagtaatctaaaagttcagccacaatgaaaattggcttcattattcttcttcttcaccaatttaaactcaagatcataaaaccctgctacctaaaaaagcaaggaagctaacaaatgagtaaaatgttcttacagaagtaaaagtgtacagtgcaacagggaatgttagtgactatggaaaactagaaaacaacatgccccactaaaatattaatctgtgcccggctctactcctttgtgacaagtctcccagtctttttttttcaatctacaaactcctaattctctaggatttccataatgttaatgaataaaatttaaattggttttaaaagtaaaaataaagggcctgtataaagcaaaccaaaatggtctgcaggctagatgcagttcctagtccaccactttgtgacactttatttcaaatgtttgctttacaataaactattagtatattttaaaataggtagaagagaagaagtctaatatttctaccataaagataaacaaacatttaaggttctggatatcccaattatacagatttgatcttttcaaattatatgaatatgttaaattatcatatgtatccccaaaatatgtacatctattgtataaaaataaaaagtaattaaaaaaaataaggccaggcacagtggctcatgcctgtaatcccagcactttgggaggcaaagcgggcggaccacttaaggccaggagttcaacagcagtgtggccaacatggcgaaacccagtctctactaaaatacaaaaagtagctgggcatggtggtgcacgtctataatgtcagctgctcgggaggctgaggcatgagaatcacttgaacccggaaggcagaggttgcagtgagccgagatcgtactactgcactccagcctgggtgacagagccagactcaggaaggaaggaaggcaaggaagaaagaaatgataccgcatacacttagaccttagggcttttatactaactttcttttgtcaagaatgctcttgccttaaatgtccccaggacccaccgtctaaccttctttaaatctgtgctcaaatgtcacctaattggtgaggcttttcctgaacacagtaaatacattaaaatggcaatatttattttgaccaatatcttctatgctttttattgcttgatttctcctcaaagctctcatcaatatctgaataatgatatattttgctttcttcttcttcttttttttttttttttttttttttttttgtgagagagagtctggctctgctgcccaggctggagtgcaggggtgtgatctcggctcactgcaagctccacctatcgggtccacaccattctcctgcatcagcctcccgagtaagtcttccaagtagctgggactacaggcacatgccaccatgcctggctaatttttttgtatttttagtagagacggggtttcaccatgttagccaggatggtctcgatctcctgaccttgtgatctgcccacctcggcctcccagagtgctggaattacaggcgtgagccaccacgcccagccgctttcttctttttatacaaaataactttccctactagactgtaaggtttatttgggtagatatttctgtccttttagttcactgctgtattcccagcatccagaaaatgtctggcacatagtgcaattcaataaatatttttcaaatgaatgaatgctgcagcctggccagtcatgagagaaagagactagatctccagtttcaagctgtgctatagaccccgggtgctttgtagtcaccctgataccaactctatggactagcaatactatgatgctaatccatacatgtttttcaaaagtcgatgtaaatatctaaagtattaaaattggtctgtgtgccttgaagtctatatcttggtgcaacactgcctctcccatttcttattttattttatttttgttactgtttttttcttttttttttttttgagatggagtcttgctctgtcttccaggctgaagtgcagtggcacgatcttggctcactgcaacctccatctcccaggttcaagcgattctactgcctcagtctcctgaggatctgggattacaggtgcctaccaccacgcccagctagtttttgtatttctagtagagacggggttttgccatgtgggccaggctggtctcgaactcttaacctcaaatgatccacgtgccttgccttcccaaagtgctgggattataggcatgagccaccacaccaggtcacgcctcgcccatttctgactttaactatagctggggtagaactgttcccctgttgtatttttctgcctcaagtctttatctgagtcacaagcaaggagaactatgggaagttaaccccgtccttaggggcagccttcagctaagagggcatgagaatcagtagataaatgcctctgtctcctgtcctttgggaagtcaattctcaggcatatttaacatactttcttaggggttcaaggctggattgagtctcagtttcccacaataactccttctacttttttcttctttacttctgcttcttggtatcacctcctaaataaactaaactgcttggaagtcctgctcttagcctctacttttaggggagtccaaaccagctaatagcagagaggcagcttagttttggtcatgtcagtaattagaaagaaagcaggtgggaaaaaacagctttaacagagatgattggagagttgactgtgtatgtattaatagatctatatatgtatgtgtatgcatgtgtttgcataatacatgctcacaaaccactgtgtagttatatctataaatattatctgggtcctgcaattagggagttttactctttttagtatttgcttgttttattattaaccagatgttgagcaagtcattgtacctaagattcagcttatacttctgtacaatgaaggagttgaacagatggttttagagtcctgttcaattccagtaatttacaattctatctgtacacatggtttgagaggaagatatgtatgccgatagggttagagctcagcctggaattctattcaactaatatgaaatttcacataggtcatatgctttaccatgtgctattgattctgttcacattggcagcatttgaaagaaagaagaaaatggctgctccatatgtttacgtgcagcaagaggcgtgaagacatttaaaactctctgtgaatgagcgcagaaatttatgcttgatacattctcagttgatcttggtttcaaggaggctaaatttattcccatctctgtggtgcagtttaccaacttcagcaattatctctttctgagaaagtgcatcctctccaaatgcaagcatttgttgatttgctcacaaaatctatgtcgttattatatctgcatctgggggcatgtagtggagaaagatcctgtataattcacaggagacatattctgaaatgggtgaatgttcacaaaaagtggagcaaggaagacccctggattgaatcatcaatcacaggatgtagcttgaatctatgatagacaaaaatatatacaaacctgcaatgagaacacatacaaagaatgctcattggtcttcagaaggcttttgaggctcaggaagtctcatcactaagactgaagtaggctgtctaaagtttgggcttattctagttctgagagcaaaaatacacaaaagaggaattcccagtatttgttaatgttgatgaaaggactccatgagcaccatttttctatctactcagaatatttcattaaagctcatgaccaacccagaaggatcctcccttttatccccaccaggatggagagcacacagtagttcatttcaaggcttgacctcactgcacagcaaggtataatatttcaattcccaagattctcacattttcccccagaataaacagagacacaggcaacagtcaaataattcacaattctacccatgtattaaacctagtactactctgttcttgcacaagtaacaaatattcaattaagaccaaaagagagctgagtgttagttttcatttagttactgcaaagcatagtcctgtattttattgtttctctttgtaagaaaatgacttgccggtgtatttacaatcatgctgaccgaagccaaagcctgggtttcctgtttgctctacgctctctcataactatggccataaaatgaagcccatgtggtagaaagacttagtcaagaagacagctaataactagattaaaaagcagtgactccattgatgaaagttaagaaaaaaaataggggaagtatacttagaaaataataaatagcaaatgcaaaacttcttttcaacataaatttaagtatttaagtccatagtgggaaaatgttaatcagtaatgaagatgttgaggtaaatagaggaactggcagcgattttatatccccataggcatggacatgtagtagcaagcacacaacccaaaagttattagaaatgttcaatttaagacctctcctgaagtaaaattgtgaatgggtccattagatatgctcagccatgctggatgtcttaactataagtaaaactcccttactgatagagtctagggcgtattgtatctagaaaaaaatggaagaactcttttgaatgaaacaatttaggaagacaggaaaaaaccagacaagtgaaaatccaattatgtgtacctaacgtcaacctgtgtgatcattctctgtttaaatgtgggatcagtgatgctgcctcaaagcttgaggatgacgggagcaggaacagtctggcagttggtatcatgccaaaaacaccagctggagacactgcagagctggcggttgagaatatggactccgaaattacatagataggtctgccacttatgagttgtgtgataaaggtacatcatctccctaggtcatgggtttctttttttttttatctgtaaaacaggcaaaataactgtatttacttctttaggctatctgtgaggattgagaacgtgcatatattctttgcacttagtgcagcatctgatactttgcaaacccactgattaatgagctattattcattgagtaatttaacatatgttgaaggttccaaatgtgggaactatgtttaacttagaactaagctatttaatatatatgttaaatgttaaatatatgttaatgtttatgttaaatgttaaatagcttagtttgaaggtaaacatagttcctgttatggcaatgataatgattatggtgacagtgatgttgacgatgatgttgccatattagtttcttagaacattagtttctggccattcttcagtggttgaaggtgttagaacagggtttacagcacatctggaccttatctatacaatggtgttacaataataaatacctatgcagaacaaatacctaaattggttaagcttgtatgtgtgtgtgtgtgtgtgtgtgtatgtacatacatgtgtatgtacatgtaattgtgggtagagcactcaggaaggtctgtcttagtacaggactaagtaacagttgttattaatatcagttaatatcaggactaagtatcagttgctattaatatcatcattagcagcagcaacaacagcaaaccagtggtgttggtgacagccagaacatttagggtctgtctcctggcagcaaggcagctaggacaagtgccaattagagacatccatctgggggcctggcagtggcagagagctgaggaggtgtctataatggtacttccagtagtttatcaagttgtaagaggatagggttccaaacagagtaggatccagtggttcaaaatgataactttgtaaatgcattttgcaacaacaactaacataaagaaaatagcacgtaaaagcccttaatgttactgtactggaatatgctgcagcacagactccattttccaccataatcttccattcctctccacacgcaaactccccttgctgattttaatcagatatttcacctgaatgaagaaactttgttggatgatgtagccccacttaataatgaccttaattcatttagtccttgtgagtctataaagtatttgcttaacagtctatttaagaaggctgttaggaattagagacaactgcaataataatagtaagagtaaaaagttattgggcatttatatgccagatacagcacctcagttttgtatgcactatcacccttaaactcaaaacaaccctctgggagaggtattatcctaagttcatagataaggggttacatgacctaccaataaaaccagagcttgtagaagtccaaggcagcatttaaatttaggtctgcccaggtccaaagcctgggcttttaattgtcatgctatgatgataactattgaaattgagtacctgtcttcataaagcttaccatcttgtaaaatactctgaaccaatggttaccaaaatttagttcatgaaccagcagcatcattgtcatctggcaacttattagaaatggggattttggggctcaggcccagacttacagaattggaatctctgcaggtggggttgtccttgttttaacaaggcctccaagggttgtgtttctcaatcttaccagcctgggtttctactccaagaagacaaggagagaggggaattatttctcagctaaagctataccttaagtactctgaggtcagaccagaatccatttagaatccactggtctgacctcagagactttaatatataaggggattctgatgcttaagaaaggttgagaaccacattaagcactcttgaaagacaagtaaggcagaaattatcagtatcccaattttacatatgagaatctgagagcacactaacatggtcaaggttatatggctgacataaacaaagctggactctagatgtattagtcatggttgactcaaagaataaggtaaatactgttttaacacatcccctttaagacaccttcatagaggagagaatgtcagagtcttgtatttagaaaaaacagtgaagaccagttttttttctcttgtaaagtttttccagagaacctgcaaattgcattgaccaaaacagaagtaatttgcacacaaatgttcataacagtattattcataatagccaaaaagtgggaacaatccaaatgtctatcaattgataaataagtaaaaaatgtggtagtcccatacagtggaatattattcagccataaaaaggaaggaagtactgatactacaacatggacaaactttgaagataccgtgctaagtgaatgaagccagagacaaaggccacatattgtatgattccatttatggactgtccagaatagacaaagccatagggacagaaagtagaatagtattttcccagagccaaggagtgagggaggataaggaacgactgctgttggatatgtgatgtctttttaggctgatgaaaatattctggcattagaaagcggtgatggtcactcaacctcgtgagtacactaaaaatcacttaactgtacattttaaaaggctgaattgtatgatgtgtgaattatatctccataaaaacaattaaatattctgaggagaaaaaaagtactactgtctcctgagagacactgtctgctgtcaggaagttagagttgctcagagccaaattccctgatacatgataaacagaattacataattatagtcctatcccagttctctcattttacacacaagtacactgatttgtccaaagtcccacagataatgagtggcataatcagattccaagtttcccaaactgtaatcccaatctgtcttccactcctccgttatggagcttccctgttgtgtgttttatagtcatggaaggtggctgggattgggggcggcggggaggggcagtcactggtctcttaccaccaccctgcccagcaacaatgtgcaacttctttaattagagaaaaggaataaagcacaaaccttcctcagagagtgaactctctcatgttaattcacctgaggtgtgatattggattccaccccaagagcagggagacttaagacttctagagggcaaaggagggcagcctctgtggtgtgagagtgatcttgaagatgcaggataggcagtcacttcacctattttcaattttgtcctagattggcatccctaggaagcaggatatcttttcatttcctgccaaacctcctggtggccaaaattaaaaatccatattgagtcagtaattaaacttccccctacctgagggttatgtcccagaccaatgctttaaaaagagttctgatacaaaaaaaaaaaaaagcagtttaatggagaaagactatctgaagaaagaatgatgtcaaatagatttaaaacgtatgaatgcagcaatatatatgttgcttgggctgcataagtaaaaagagacaaaaatcaatctaaactccccagtttcaactatattgtttccacatgcgtgacatctataccagaaaaaaactaacaaaactagaaatgcattcctcttggaatggaaacaaatgtcaaaacaaacaactcaggataaacttgagctagagaagaaagctttgctctactcttttctaaggagctttgaagatctggccatggttgacataacaactcattgcagcagatatgttacttcaacagggagcatttcacagattgtcaaagttgtcttctcatcccatccaacctatcttgggggagggtgagaaaaccgaagagcaaaaagattaattcatttgcccaagttcacatggctaagtgctttcagatactgggaatgtttgatttacttgaatcaaaatagtgagaatgtcttcctgaattatacttgataatggttttctagttacattataacatgtctaagctctatataaatgaaaatgaattttattaagagtgttttagtatttgattggctttgtcaaaagatttcagatagtggttttggggaacttggtgaatgcccatgcagtttttgatacagtggcaaagaatatttgtagaagatatgactttttaaactctagaacttataattcctcagaaaatatttacgcattctttatttattaatttatgaatgaaataactgttcattcatttaataacaatttgttaaacacctatattattgggtactgatagatgttgggtgtaccgagatatctgtgatttagtccatgaatttaaggagtttataatcttgtgggctgacacaatttgtttcaaactctgttctgccagatttaagtgagaaatccaggcaaaatacaatgtttctgtcaatgaaccatattgttacagtatcagaagctactgccttggtacagcccacagtggataagatcatggtcctggggctgagaaaaatctgggttcaaaacctacctgtaattatagttgctcagtgtatgagcttgaggaaattgcttaattctctgagaaaacatttaaaatagcccagtaactgccctatagtcagcacttaataataatgtctattgtagtcatttattaataacaaaaggccatggcctcctctctttatcgctgagctccaatgcaagtaaaacacttccatctactttaccttcaatgggtcctaacttgcatagtaggaataaagaaaaaaggaaaattgtgggagtaggagggaaagagagaatgccatgagccgcatgccttctggcctttctgtcattttccaggtatctattcttccaagtaggagggtcaaaagtgattgtgtttagttttgttgtaaagttgaccaagaacggaataggtctgccgggcacagtggctcgtgcctgtaattccagcactttgtgaggctgaggcgggcggatcacctgaggccaggagatcgagaacagcctgaccaacatggcgaaaccccatctctactaaaaatacaaaaattagcaaggcatgatggcaggtgcttgtagtcccagctcctcaggaggctgagaatcacttgaattcaggaggtggaggttgcagtgagctgagatcgtgccactgtactccagcctggatgacaaaagcaaaactccgtctcaaaaaaaaaaaaaaaaaaaaaaaagaataaaaaaaagggaacaggtcacaatttccctcactatcaaataattgtttgcatttaaggggaaggaggaagaaaacaagcttgatgcctattttgtttaattatattattctcagggtaaaactgtatcttgttctctacagtggtaggtaggtaggtagatacgaagtaggaaggtaggtaggtaggtaggtagatagatagatagatagatagatagacagaaaaaaatgtatataagcacttttttctgtatttttaccaagtctgttgggcaatctgttgatatttgaactagataattttaaaaacagaggaaaatactacatcactcacctaatattttgtcattaactacaaataattattattttaactgatgtttttacatcaaaacatgacttaaaagtcctaagcaaatttttcactactgatgatggtaatgattaaaaagtcaggaaacaacaggtgctggagaggatgtggagaaatagaaacacttttacactgttggtgggactgtaaactagttcaaccattgtggaagtcagagtggcgattcctcagggatctagaactagaaataccatttgacccagccatccccttactgggcatatacccaagggattataaatcatgctgctataaagacacatgcacacgtatgtttattgcggcactattcacaatagcaaagacttggaaccaacccaaatgtccatcagtgatagactggattaagaaaacgtggcacatgtacaccatggaatactatgcagccataaaaaatgatgagttcatgtcctttgtagggacatggatgaagctggaaaccatcattctgagcaaactatcgcatggacaaaaaaccaaacactgcatgttcttactcataggtgggagttgaacaatgagaacacatggacacaggaaggggaacatcacacaccggggcctgttgtggggtggggggaggggtagggatagcattaggagatacacctaatgttaaatgacacgttaatgggtgcagcacaccaacatggcacacgtatacatatgtaacaaacctgcacattgtgcacacgtaccctaaaacttaaagtataataaaaaaaaaaaagaaaagtaacccaatacagagggggagaaaaaaaaaaaagctaatgaggctagctaggctcagtgtttctaggaatgatgtaactagaaccatgtgacttttatcatatatttcatcaatgaagataataaatgcttaaacaagataattaccatcctccttcctctctgttaaatgcttcaaatacattatataatttatactgggctcagagtagccctaatatggctaatattggtacctctgtacctctgtattatagatggggcaactaaattgggtcaagtaagtggctgaaggtcacacaagcatggcctccccagaaccagatacttcccacctactttgtcctagtcaaccttagcttccgaccttactgtgttccttccagtgcaacattctccatttttgttgttgttgtttgttgttgttgttttgtttgttcatttgtttgtttttgagacggagtcttgctcttattgcccaggctggggtaaaatggcacaatatcggctcactgcaacttctgcctcccacgttcaagcgattctcctgcctcagcctccagaggagctgggatgacaggcacccaccaccacacctggctagtttttgtatttttagtagagatgggatttcaccatgttggccaggcttgtctcgaacccctgatctcgtgatctgcccgcctcagcctcccaaagtgctgggattacaggcgtgagccaccgcctgcacccctccaccaacactcttctttttatagtccctgtgcggaaactcaaaccatttgtcccctgtcccagtgcctcttcagtctagtccttcaatagcttcctcctcagttactgatttgctacatgactatggagacaaccagattaaactgtgtagatgtcatttcccattgctttatttctgtaactgcaaccacactgtagtgatttctgctttccctcaagaagacaactgtcctccaacacccaacattttatctctgaattgttaccttatttactctgcagcccctacagtagcagtcattatgtctcctcctgacctactctggtatgttctttctcccttcctccttccctcctttgatttttcagtctaattatatcttagcttagaatataaacttttagctaatgaaattttcttcaaacatgccttcaaaccccagctgttcatttccctctgagttaaaatgagtaaagttttgattatgtttgtttaaaattcactaggctaatatatccatatattgaatgtattccatatacattatcttctgtacttctttaaaggcaaatgtgaaattctctaacaaagtctttcctataaaaaaatatgacacaccactctcaggggaattatgataattcaaagaacaaaccaaaccaaattaaactcacatcttttctgagcaaaagagtaaataataaaaatgcagaagtattgtttgttagggtcaacagcttttgctagaacctgatgtgatattctgtatagaattttgttgggaagttatgaagtactgataagacaggcaaatattatttgcacacaaatgatccttgcaaaataaaaattttcaagtggagataaattcttccttatcctctttagttcttcagcagggttcttggataccgtctttgggaatgctcttctctccaatgttgtgatatttacatgaaaactttggttttaatgtaatatttatctaactagatataaccagacttgaaggtgattctctagatttcttgtacctcccttatgatttcagctatgcgctcgattcagttgaatttaagaagattatcaatggcatttcataattgtttatggatttcatattatttaaacttgctctccagttcagtaaataaattttagaggaaatcaatattatgaattttttttcagttattagaaattgcttttgagttttagtctttttctttctttcttttttttcttggtgtaattgtaatagaaacccaaggagtctagaactgtacttgctaccttctggttttgtgactttgatcaaatcactctgcctctcaggatttcagactctgcacaagtaaagagtgagatggagcacaagtgagctttctaggtcagcgtttcccaaaattttatcatctatttttgtccaatctctacgctccctgtattattattctctttaattttttattaattatgttttttttttacttgaaggaactttatcacagcagtatcacttgttataagtaaaaagtagccgtaaagataaagacaacagaaacaaatgtattaaagcctggcacgtcctcagaagactctgctcctgagccttgatagttcaccacaagtataagactgtcatgtgtcagagagattttaaagacatgctggcaccaagtgagactttatttttagtttaatcagaagaactcaaagagaattaagtgaaagaggagtgacttattcttaagtgagttaggttttgtttgtttgtttgtttgttttttgagacagagcctcgcactattgtctgggctggagtgcagtggtgtgatctcggctcactgcaacctctgcctcccaggttcaagctattctcctgcctcagcctccaagtagctgggattataggctctcaccaccatgcccaactaattttttgtacttttagtagagacggggttttactatgttggccagactggtcttgaatgcttgacctcgtgatccactcgcctcggcctcccaaagtgctaggattacaggtgtgagccaccacgcctggccatgagttagtacttttttagtgcctgatctctgtacaatccaaaaattatctcccattccagtgttgtgcatcttgcgtttttagaaatgctaatgtaaagaggaagcatcttccagctctaaaaaaaaaaaaaaaaaaaaaagtggatgctgtaatgccccaatgtaataatatattctggcaacagtgatccagatgaatcatatttttgtgtgtgatcagtttttctttctacatttttcatataggtaaatatttgttgtgtattttaactcatgtactaggtaaaagttgatgtaaatcaatttggggctaagatgtaataatactgttgcctttatggtttaatttaatgatgttgaaaagctttctaagtagtaaaactatagctcattttattccttgcctctccccatccataatagcatgcaatgagtgacataaaggggccagattaacccctgaactgcagccctagaacagcgatggcctggcatagaaagttattgtgactggagatcctttaatcaccagagtattttgacagagtgctgagtagttgcggcattagtagtaggagatttgacacagaaaccattcttaaagtcttggggagcccagttggctcttaaaaacacaacttggaattcctttagtttcagtgccttatttttacctttctttgaagtgcctttttgttcactgatctgttaaaagtgcaatcttgtttctgtttttagccatccattgctattaccataataagcccagtgtttcaaacatgtgtgtcttagagtataattcttccttactcaagactactcaagccattccttccctcccacaaagatgatatctgaattgtgcaggcattggaagaatgcaagtgtcattctcaacttttttttcacctccataaaataaaaacaaacatttatgacctcatgcaaactttttgggtcaggaatttgggagcagcttagctggatggttctgattcaggaaattatactccagtatcagctggggctgcggttgctgaaggtttgactgcggctagagcacccactttcaagttggctcagtcacatatgtgactggcaggctcatgccaggtgttgacggtaggcctctcttctgtaccgcatggagctccctatggctgcttgagtgtcctcgtgacatggcctgtggcttccctcagcagatgatccagagagaaagcaagaggaagccaagtggcttgttgcagaagtcacagttgtcagttccataatattcaatttattataagcgagtcattattttctgccccacactcaagggaagggaaataagttctatattttagaagggggagtgtcaaagaatatttggacgtaatttcaaaccaccacaatctgttcctctcctttgctttcatactgggacaaactgtcgtcagttcttacctacacaacataatacgattctggttggtcttccctcatcttcactgctcttccactcttgtgcatttctaatccattctccatggagaatcccaagtgatcatttgaaaacacaaatctatcatatcacctttcttctttttttgttgttttgttttgagacagggtctcgctctgtcgcccaggctggagtgcagtggcacgatcttggctcactgtaacctacgcctcctgggttcaagcaattctcatgcctcagcctccccagtagctgggattacagacacatgccatcacgtccagctaatttttgtattttgtgtagagacggggtttcaccatgttggccaggctggtctcaaactcctaacctcaagtgatctgcctgcctcgcacttttctgcttgggtggcttactgttacacataggataaaatttagagatcttttcaaggcatataatgtcttacatgagttggttcctgctgccttctctaacctcatctcatacaactccctctgagctcactagaaattctaatcttcttttccattactaaatcatgtcaaccgcttcctaactcagggccttcatacctgcgatttactttctcttttgaatggtctttccccttcctccttgcctgtctatgcctagctttatactgtagatttctgcttaaatacctctccagcagaaaaacttttcctgataaaacttagatagcactgtatcatttgttttctcttttattaaaaaaaaaagctgtattgaagtataattgacatgcaataaactataaaaattaaggtatacactttgatacattttgtcataggcatataactgtgaaatcatcatcaatattcgaaataatgcatcactccaggaggtccctttgtggaggatccttgttattttccaagttggaaacagtgcctagaccatcacaatatttcttacaatttataattgctaattgctttcatctcagtttgtagtaactcgcttgtgcatctcaccatctagactggagctccatttgaagagaaaatgtgtctgtagagttcattgctacatctccatgatcacattgtccagatgttcaataaatttttgaatatatgaataattgtttgtattataagctgataaagtcccttaaagaaatacaagtcaagtgcttagatacttttgatgtagtctgccctttgaagaactagtagatttgtgacttttttttttttttttttttttttttttttgagacggagtctcgctctgtcgcccaggctggagtgcagtggcgggatctcggctcactgcaagctccgcctcccgggttcacgccattctccggcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccgatttgtgactttttaaaattgtagccttctgaaactaagcgaaaaaaaatatgaggtgaatttttgaaaggcctaaacgaagaaaaatgagatcccaacttgtctctcatgtaagggaggtaaagaaaagtaagtgttgaatgccaggtgtagtagtctgctctttatttgagtcgagactaagaagcaatcattgaaaggtttttatttttttatttatttttattttttgaggcagggtctcgttctgtgagaccaggctggagtaagtagtgcaatcatagctcactgaaacctcaaactcctgggctcaaggcatccccctccctcagcctccctagtatgctgggactacaggtgcatgccaacacacctggctagttttttaaaattttttgtacagatgaggtttcactttgtttcccaggcgcatctcaaaatcctggcctcgagcagtcctccctccccagcctctgaaagtgttggacttagaggcatgagccactgtgcccggccttcattaaaggttttcagcttggccctgactttttattgtcttggctttgcctcaggacaattaatatggcactgatacataagaaaacatatgaatatcttcgagacctgtactttacctatctgcatgatttatatcattgcaaataaggaagaaaagttaggaaaagacaaatataattcaaagtgtttaagttttctgaaactagagggttggtgatatggtttggttctgtgtccccacccaaatctcatcttgtagctcccataattcccacatgttgtgggacgtaccgggtaagagatgattgaatcatggggatgggtctttcccattgctgttctcatgatagtgaatgggtctcatgagatctgatggttttaaaaacgggagtttctctgcacaaactctctctttttgcctgccaacatccatgtaagacagaactttgtgcctcctttccttccgccatgattgtgaggcctccccagacacgtagaactgtaagtccattaaacctctctcttttgtaaattgccccatcttgggcatgtcttcatcagcagtgtgaaaactgacaaatacagttagtttaaccactctctggagtgttctattcatgggttggtaacaaataaaccatttataatttaaagttttcacagccttagaaatgctcacatagatgttaggaaatagttttggtatacaacaaaacagaacctttgtgcacatttatttttgtattatattgtactgagggtttctaatcaggtgaagagaaaagcagtgtcagaatgggaagtctgaatttgaattggatatgtttaagcaaattgtctctttaccagccctacctaatttgagaatacataacacccactcagctctccctgaactcacatgttggattttcccaactaattttaatacacacagataaaaagaccagatatttggtctatacattttctgaatgtatggaaacatctatttatgtaacaagcataatattatagctgaaattgaaatcatttttgtattttggtggttgttgactggctaatagctaataagtcaatgtcaggatagcgaaatcccacatgtattcaaatatttaactccaataaataacatttgttcattcagcacctactaaatgaatctacctctgttaaccttcgcaattatcggataggtagatacattgagattatccctgcttagtagatgagaaaactggtggttaggtataattttcccatggtaatgccacttaccagtagcagagttgcaattgaaacttggatttgtggcctctgaaatgatcaagtaatagttattgatttttaagttcatgtaatgacaactatttgtttgatcttggaatcaggactgagtatttttgatagaaaggaataagtcatattttggatgggcagatgaagatcttataagaatgttactgccacagcttatacctaaacatgttgaaaatattttagggaagagaatgtatatgttgatggatttgtgttagctgcttttggattcaatgattaaagccagttttgccttatagctaaaagtatctgataaaaaactaatcacttgtcataaagaagagaagtggaggctatgtcatcattaccatcaccatctgaagtcgtcaaatatattgcatttcctgtgatgtcccagttagttccaagcagttatatttatataaaatcatatatttcagtaaatattggagctttgtaagaataacattattttaacataaataggtgttttcagacagtctcattatttgtgtattccaaatatgtagtaccttgaagaccttgacttatttgagaacagcatgaaaatttgcctgcctgaaaatctattggcgtatattcaagatacgttttacaagcaggagattattttgggagcataattcatcactttgcttacatagttgttggctctttgtctggcatttgattggagagctacattttcttggagtaatgttgaacacaattttggagaaactggtttttttttgacaatttgaaatgttactgattaagatcccttgaggccaattctatacacaaagtacatatttatccattgattccatgaaaacataaaaattctttccatttagtaaatagataatttggtacaggattatttgccctggagtaactggttaaccagggtataataaaatggatcttttttttttttttttttttgagacagagtcttgctttgtcagccaggctgtagtgcagtggcacgatctcggctcactgcaacctccctctcccaggctcaagcaattctcctgcctcagcctcccgagtagctgggtttacaggcatgtgccaccacacccggctaatatttatgttttttttggtagagacggggtttcaccatgttggccaggctggtcttgaactcctgacctcagaatcggccagccttggcctcccaaagtgctgggattacaggcatgagccaccgcactggccaacaaaatggatcttgaagagttccttcacattagatcagaagaaatgtgtatgtgtgtttgtttgtgtgtgtgtgtctgtacctcctgtaattgtcatgtgtatatgtttgcatttagagtagttttttcttattcattttcaaaaataaataatcaattttgcattatttcttgcctctgatcccaatctattagtggaaagaagtgagattcaaccataattggaaaagtcatcaccttttaaaagaagtaacattggtcacattagtcccaattccatctcacattgggtatgtgaccagccttgaaccaggtgaaatatagaaatacagaacttcagatatgatccaagctatacattagtgggaacagtacatcccttgatagtgacactattctatttgaatgtcttaaggttccattgacatgcttttattagctccttcaaaatgttggctaatattacacaattgactgagtatttctgatgcatcctttctgttaataccaaatgccaataaatttcatggtaaaataatttgatattggcattttaaagatattatccttagttttcatgccagttagatcccatctgagtctgcatgtattaatagacttcaggaaaaattccacaatgtcacatatcatgcatggcctagagaaaaggctttattgggaaatttacatatgtcaagatttaacaatgagaagagaagccaggggtcctataatcttccacatcccacctaaaggtgtggcaggacctggctgccttgatcctgcagtgtggctctgtgttcctagcaagggtccgttctcttcagtagcctaccttgtcaatgaaggataagtggaccccttggctccaggcccccagagaccctcaggcgctgtgggatactaaagtatcccttgtgtggaggtggaagcccctggttgtatgataagctgagcttgggtgtagcccctcctactgggagaaggtaggatatccctggctgtagttgtcatattgtccagagttcagagagtgagtatccagcgttattttgagtcagtcctgctcatttaaacttacaacagtagatctgcatgatccccaaacacgcaggtataaaaattttctcaaagttgaccacctgttagacaatctcatcatttagtggaaacctcactgtaatcgccatgaggattatgtatcatcatctgttgtatgtgggtggcattgcactagtactggataaaacaagtgaagctatcatggtttttctcttctaagagtttattagatgacatcattctcaaagtctaaattttgtgaataaaaaataacactatagcatgtgcctttacatgaaggtttaattaaaagcaatgaatgaatacatatgcttcaacattaatctcactgaatatatttttaagaatcctgcagtttgactgtagataggatgaaatgttaaaaatagaccctaaacccaccttgatttatgtatttacttggagagaaacaggtgagggaagcatattgaatcataacctaattcctacaaacattgatttacacacaaattaatttactaaacaaattatagtttatacatttatacattaagcatatttatttaatttaaacatactagtaaaatggacatcggttgtcctccaaattctttgtgttttcatttagataaagatgataatgttgacaataatctgaagcttaataacagaaatagcaatcatgtgttgaatatttattctggtggtagtaaggaatcaatccatatatatttacacatctataaccatacacatatgcatacatatataatagataatatatatttatgcacattttgtattttttttcatttaatctgcacaccatcccttaggagtaacttatttttatgaatgcttctcagataaatggagaattagggaagtgcaatcatttgcccctgttcactctactagtggaagcaggatttgaatctaggcgatttgactctaaaggtccatgctctttatcactattcaatactgcagatgtaaattataaggccattctatccatgtaattttaatacaataaatgctatgtgctgagtgttttttaaagattaaaatttgaatctgcagtaaactggctacttatcttattgtcaaccacatctttttcggtactgtgtccaggacacagttagatattaagtaaaaacatccctggtcattttttttttaaatttgagtttctctggcttctgcacatagcccatataaactcagaaacccgttatttggagatttcactgaatgaaataccataagctttgtagtgggaaggggttgtaagaccaggtcacccaaacttagtttgcaaatgctgcagcagctactcttagcagccactgtcctttccatagcatttccaaggcacctgcattcttttgcagctactactacccaccacacctcttccttagcagttccatagccaagatttcagagattgttatgaaaatcacattgaggccagtacttcgttagaaatttaataaggactacaacattgggttgcaaaggaaggggtaatgcctcttctactaccatttgtagtttgtcctctaggttcagcattaacaatttttatgaagtattaggagctttcaagggcctttggcagggagcaccttatgcctcaatgaaggagccttaagcaaagttaataaaaatgcgaaagtattgtgtcttgacataaggctcctgagtcgtaatgttgataatcttcagcatagagctctagcaacatgatgcatctggtgtctgtaacccagctgttccccaggaaaggtgcagaattgagaatcatcagcctgaaggcatgcataaaagacagcacctgagaagtggtgctgtgtgcctatggaagagcccagtcagaggagtacagacttcaactgaaccatcccccagtatagagatgcgcacacgtcaggggagcataaatgagaaaactggactttctcaagcctgaggtgttggataatgacctgacagcgttctcactagtcccataaaacagcctatgtttgttcccatctaatcatgtgactagaatgtaggagagtacttctaaaagtaaacacatttgaacaatctgtatgtaggaggaagaaagtactgtattaaaattgtcagtttttcttcttatttttccttacctaatgaactttttggcatctatcagtttctaaccaggcagctgctgaaatttttattcatgccttggtttcctcaagaattgatttttgtaattcttttttgcagccttcccttaccgggctattttgaggttgcagcacactgtgaattcagcaggtgcttcaagcctggcagcatcttattgcctttcttccgacttcctttagtgacctccagtatcaaacatgattgctcttccaattttaatttctacttgctgtggtaccgaacaacctcgttagtcctatcactgagcccagttggcaatgttgggaggtctgagtagttccacactccgtaaattgcagtggtattagcaagtacaattgcatactcttaatcatcttgcccttattatatgagaagtttctggtgtattttaagggagaaaatgctttagagagtaaagagggaaaaaatcaaagcaaactctccctctcaatattctaatcacgaaggactggaattttcaagaaccaatttcaatttgatgcttcaatatagaattgaatttagggtgtatgtgagtgagtgtgtatttttgcacacattcacatatatatatttttaatatggtacttgaactgcaataaagccagtactctttccttgattttatgtagaccacttttacatcataattcaaaaatataaggaaacttatgtagccgtaatagaaattcagtagaattagaaagtaaaagcaacaaaatataaagggctgccagcagctaagccttcgcaaatcagttcagttagttgatgtgtttatttgtgcatgtagagccattgtatttgtacaaatgtccctccaacatatatacatgaaaggggtattaaagatccactctcttggttttgtggctgaacaaattgcctcaagctcttactaatggtaataacttttcctatttaaagggcattttcaaatgggagaagattgttattttttacttttttaaaaataatttctgatctaaggaaaataagctaacatctatacaacagaatacattattggtaataactgacatatgttgagtattgtgtgctcaacatatatagcttggtgtataccttatagatcattaaaaatagcaacactgtaggtaagactgggaaaatgtatgttgtttatttcagagattagcgtgtatccacatgtagggaccatggagtgtagagttggaggttcggccaaagccctcctgggccactccttggcaatgttactagttgtaggttccattctatcacagttttaaggatgatgaaactgaggcttatagaatttaagtgatttctcaagatcatagagctggtaaatggtgaagaaagaatttaaaactagtatatctgaatccagaatctgagctgttgactaacatgtagcattgccatctccaatccttggggatttatttttcacagggcctaaatgtgtggaccttttattctgatgcctttttcttcattctttttgtttgcttaaactaaaccttcttttgaactataaaggtgatggtgagtaacaagtcccatgtgtgattttattgtacacagtcagaagacagaagacactcagacagcccatctgctcagagtgtggcttacatcagtttctgtattacggctatcttttgtagaatgatttgtagcctttatcaaacttctcttggttaaaagtttgtaatggcagagaatccctagctaaacagtcagagaaagtaattccttagaggaaattacatcagcattattcattattgcattagagagtgtatttttgtcaattctctagcagagatcaagttcctgagggaattagatggagaaagaagcattgggtatgaattggatgaggttttatgttgcctgaagcttgagttacttattagcaagagtccaaaacatcttctttattgaagtttggagctatctgttcctcaagtgacaaaaatgttcaaccttcatttggggattctaccccaactctattttggtttatggaattcttctttttttttttttttttttttttttttgccaaaacattctttatttggtcaataaagggcagaagttttggattcttaaacattcagtatttttttaaatttagtccagggtttattcaaataccattttgccccaaactactctctcctctctttctggggctctaattatatgattgttagaccttggagggcagcttagattttttttatactttaagttctagggtacatgtgtacaacctgcaggtttgttacatttgtatacacacgccatgttgtgtgctgcacccattaactcgtcatttacattaggtatgtctcctaatactgttccttcccctcccgcaccccacaacaggccccggtgtgtgatgtcccccttcctgtgtccaagtgttctcattgttcaattcccacctatgagtgagaacatgcggtgtttggttttctgtccttgtgatagtttgctcagaatgatggtttccagcttcatccatgtccctgcaaaggacatgaactcatcattttctatggctgcatagtattccatggtgtctatgtgccacattttcttaatccagtgtatcattgatggacatttgggttgattccaagtctttgctattgtgaatagtgccacaataaacatacgtgtgcatgtgtctttatagcagcatgatttatagtcctttgggtatatacccagtaatgggatggctgggtcaaacggtatttctagttctagatccttgaggaatctccacactgtcttccacaatggttgaactagtttacagtcccaccaacagtgtaaaagtgttcctatttctccacatcctctccagcacctgtcgtttcctggctttttaatgatccccattctaactggtgtgagatggtatctcattgtggttttgatttgcatttctctgatggccagtgatgatgagcattttttcatgtgtctgttggctgcataaatgtcttcttttgagaagtgtctgttcatattcattgcccactttttgatggggttgttgtattttttcttgtaaatttgtttgagttctttgtagattctggatattagccctttgtcagatgagtagattgcaaaaattttctcccattctgtaggttgcctgttcactctgatggtagtttcttttgttgtgcagaagctctttagtttaattagatcccatttgtctattttggcttttgttgccattgcttttggtgttttagtcataaagtccttgcccatgcctatgttctgaatggtattgcctaggttttcttctagcatttttatggttttaggcctaaaatttaagtcgttaatccatcttgaattaatttttgtataaggtgtaaggaagggatccagtttcagctttctacatatgggtagccagttttctcagaacctttattaaatagggaatcctttcctcattccttgtttttgtcaggtttgtcaaagatcggatggttatagatgtgtggtattatttctgagggctctgttctgttctgttccattggtctatatctctgttttggtaccagtaccatgctgttttggttactgtagccttgaagtatagtttgaagtcaggtagcgtgatgcctcccgctttgttcttttggcttaggattgccttggcaatgcgggctctattttggttccatctgaactttaaagtagttttttccaattctgtgaagaaagtcagcatcatcctgataccaaagcctggcagagacacaacaaaaaaagagaattttagaccaaaatccctgatgaacattgatgcaaaaattctcaataaaatactggcaaactgaatccagcagcacatcaaaaagcttatccaccaagatcaagttggcttcatccctgggatgcaaggctgattcaacatacgcaaatcaataaacgtaatccatcatataaacagaaccaatgacaaaaaccacatgattatctcagtagatgcagaaaaggccttcaacaaaattcaacagctcttcatactgaaaactctcaataaactaggtattgatggaacgtatctcaaaataataagagctatttatgacaaacccacagccaatatcatactaagtgggcaaaaactggaagcattccctttgaaaactggcacaagacagggatgccctctctcaccactcctattcaacatagggttgaaagttctggccagggcaatcaggcaggagaaagaaataaagggtattcaattaggaaaagatgtagtcaaattgtccctgtttgcagatgacatgattgtatatttagaaaaccccatcatctcagccccaaatctctttaagctgatgaagaacttcagcaaaatctcaggatacaacatgaatgtgcaaaaatcacaagcattcctatacaccaataacagacagagagccaaatcatcagtgaactcccattcacaattgcttcaaagagaataaaatacctaggaatccaacttacaagggatgtgaaggacctcttcaaggagaactacaaaacactgctcaacaaaataaaagaggacacaaacaactggaagaacattccatgctcatggataggaagaatcaatatcatgaaaatggccatactgtccaaggtaatttatagattcaatgtcatccccatcaagctaccaatggtttatggaattcttatgtatagatagcttcagttcacccaaggattacaagcattatatggtaataatacatgaagaagcagagaaaactaaagtacaggttgtcttccttagcaagtacaacctttgcccactgaatgtgctttcttaagtctcagctttgagaaaaagcaaggcttaagtaaggggggttccagtgagcagacattagagtatttcctattgtattaaggcaactgaatgaactgtttgaaagtttaactctcagggtggcttaggtggcttagtaaatacaattatgagaggaaatgttttcttcacttacttgactgtaatttgttgttaagatatattttgaaattgttgagtattttctcatttttctgtgcctctcaattttctgccaaaaaaaaaaatttctgagaattttgtttttttcatttaggatggaacaaagttgctgttactctatgtgattagggaatgatgttttaggtgaattaaataataaatgatttttcccatatgccaaacatggaagactaatgagatttgaaatgcagcgtatttcttgatattgaaaatatacaacatgaaattttttctttgattcagaaggtactttaggatgtcctagtgtgggaaaatcattagaaattgtcagtctcttgtaacattatggaagtcctggtttatcggtatttttctgtggtgagagaagcaggtaatcaaatctttacagaaacaaaatcctacagaaaataatgctggcagtctgctgattaaagtgtctgaataaaatggattaggtaaataaaaagaatgagcatataagtagaagaaattgtagtttctaaatattaaattcagaaagttttgattaatgacttacgtttcatgtcatatggcttaaagattttttgccttatttcttatccttgaaaacaaagtgaagtgcatatgagagctccggtggaataaaaacagcccgttatgggctggtctattacttcttcaacaaagctctatctactgtcatggggcagcttagtatgacagaaagaaaacagatgtgtgtttcagctcttctgcttaatagctttgtgaatcagccaggatatacaacatggtgtagttgtgctacagtagaaaccctttctgaaatttccctggcacagtactgcacgtgtgtatgtttgactcacagcgcattatccaaggtgaattggcagagggcctctgcccacgggtcattcagagacctgggctgatggaggctttctgtcaatgcctgcttcaaacaccgtggagagtggaaagggaaatgtggcaaatcatacaggctcttaacatttctacttggaagtgagatgtaatttctgtcacatttcatctgccagagtaagacacatagtcaaagaaaaagaaagtaggattctaccatatatccagagagatatcactaatgacaaccacaccatgtgtttttgtataaatctcttagtgtgtctgagcttcattatgctaatctgttattttttttaaaaagtggaggatttccctgacttgatgcctcttcctgtgaccctcctctgaacttttgtgtatcctagtcaccagaggaaagatgttttttcatttattcaacaaataattttcagctccttctatgtaaggtaccagctaggctttggagacgttgcagaaaacaaaaataggtaaggctgatctcccagttcttatgttcagttggattgacaatcagcaaaatagatacatatctatgtaatatttcagttggtaaaaagtgctaagaggaagaataaagtagggcagatttgttccaaggaaaacttaagaaaaggggggaaataatatatgaatatcagtaggtgaaggtttctagatgatagaagaggaaatgcagagccctaagcaggattctgctaggcattttttaaactactttattgaggtatgatttacatataaaaagctgtacatatttaagagatacaacttgatgtgtctagagataagaatacacccatgaaaccatcatcacaatcaatgccataaacttattcatcacctccataagttttctcctgcccccttgttgttgtttttattttgttttgatttcctcttatagtaagagccaataaaggaaatataagatctaccctcttagtacctttttaagtaaatagtacagtattgttaatcatatgctctatattgtaggggagatctccagaacttattaatattttgcataactgttctgctaggctttttaaacatttatttagagacagaatcttactctgtcacccaggctagagttcagtagtgtcatcatagttcacggcagcctcgaactgctgagctcaagtgatccttccacctcagctcccaagtgctaggactccaggcatgcacaccatgcctgtctaatattttattttcttagggacaagttcttgctatgttgacaaggctggttttgaactcctggtctaaagtgttcccgagttgggattacaggcgtgagccaccatgcccagctctctgctaaacattttgagaagcagagagaccaggatatctggagtgcagtgagtgaagacagtgttaggaggtgggagaaggggatcagagagaaggcaacatggcagatcatgcagggagagccctgtagcaaggtaaagactttggattttttttctggatgagctgggaagcattgtagggttttagacaaaggggtgtcttgatatgatctaaattttctctggcttctctgtggagaataatctatagggtggcagtgatggaagcaggagcacagctgggcagctattgcagcaatcgatgtaagataaggatggcttagacccaagtggtggaggtagagattgggagacatgccagattctggatgcattttgaaggtggagctatcagatttgtgaatggattgaatgagagatatgagtttaccacagtaattattactatatagatgccattcatttataccacaaaaccaaccgatgtcctgtcaggtgctagtgctgttccacagttggggttacagcagttgggttttcatgatgttgaattctagttaaagaagacaaatgataaataattcgaataataattttaatatgataatagtcagtagttagtgctagaaagaaaatttaatcaaggggatgtgaatgatgtaagtggctacgttggacaggcaaggccttggggagctaaggcctgagccaagaggactgagatgtgaagtgatgggggaagcaggggaatttggtggggcagcactcgaggcagacacacatgtagtgcaaggatcctaaggcttgggtaataggggaagatatgtcattgcagtttaaatatcgaatggggggacaaagtggttctgtattgatagggaggtcagtatggaccagatcacactgggcttggcaggacagggaagaattttagattgtcgtgattccttggcaataagaagttattgtaaggtttcaaacggagaacaatataacctaatttgtctttgacacagggaggagaacaacatacactggggcctgtggtagggcaggggtcgagggggagggagagcatcaggaaaaacagctaacgcatgctcagcttaatactcaggtgataggttgataggtgcagcaaaccattatggcacacgtttacctatgtaacaaacctgcacatcctgcacatgtatcccggaacttaaaataaaataaaataactcacagtgactgatgggcggataatgggttttaagaggactttgacaacgaaaccatttaggaagctattgtgttatgactaattccatatgcttttcttatctgaacacaataagttgacattagttttgtttttaaagtgaaataaatatttgcccctccatgctcctacccctgcttgttcgtcagcattcttagggaatgaaatgatccacagaagacttcccaaatagctgtggtttccctctttaaggtctgtgtctttaaaagcacatggtccatttcagtgaaagtttttctgaatatttaatacatacttaccatttaaatggaagatagtaagtaaaacctaaacttttcctttgcctcatggcagtattggtgttggttaaaaatgataacttcagagacttcagatctccagacccatgagctttacagatgctagctctattctttttccattggctcctgactgtgatgtccttgtgcttcgcttccacagtctcctatccccaggtttttaggacacatttaatcttctttcttgatacagtgctacttctcttgttgagtatttgatggacttggtgactgttacattcttccaaggccacctttttttggcatctggttcaaactatgtctgtttttgctagaaactgtcacgtgaataaaggaaagagtagaaattattgtagtcatattgcagagcaatttgaacattccactgaagttgaatatgtgctacctacaatctagccatgataattctagatatatgccctagaaaagcaggtgcatatacacaagaagacacattactgggatgttcaccaaggcatcatttgtaatagcaaaatggtagaagcaacctaactgtccatacaaaaagggaatgaataaataatctgtttattcatataatggaatattgcataataaagtaactgaattaaagctgtatgtatcaataagaataactgcaaaaatgtaaagtgaaaataaaaaatttcaaaaggatataaaaacgtaatgtaatgctctttatatatattttagaaataccaaaataatacgtgtgtatatacatatgcatccacacacacacacacataactaatggctaatacagtataaaaacatggtaatgatacataaacctttcagaaaacttcagtgaataaaagcaggtagaagagagaaaggaggacctagttgaatctgccctttttaaatgctatgttaaaaaatagatacatatgtttttaaccaatctgtacaatgttcttacctattatgtctggcttttgattatgtagggtatcaatttatgattttttccatacgatagaaatatttaataatttaaaatatcatataataaaaacgtgtcttttatagttcttcctacaagctgtatttgatcacttctgtggttttatgggtggctcataacatctagtcacatcataaaattcttttttccttgtgattggctgaatcatctttaggcgtgatgcttaatttagacgtttaggttaactcttcaataaaatcacaggaatttattgtaagatctaaccaagggactgaaataaattgaatgtagtgaaatttgaggcattgtttcagccaccttaaagaccacatgatctactgatacagttgttaaatccactcagataaacatgtgtgctccaagttggagaaatctgaggcagagaaaaagaattgtcccaggtgcccaagtccacttatatgaacaacttgaattgaacactgttaatattaggctcttttgccaggagtggtggcatgcacctgcagccccagctactcaggaggctgaggtggggggatcactagagcccaggaatttgaagctgcagtgaactatgattattccactgcactacagcctgggcaacatagtgagacgctgtctgtttaaaaaagaaagaaagaaagaaaagaaaccctaggctcttcttcccctctccccagacaaagtctgctgcagtgatctcggcttactacaacctctgcctcatgggttctcatgggtttaagcaattttcctgcctcagcttcctgagtagctggtattacaggcacgtgccaccatgcctggctaattttttctctttttagtagacatggggtttcaccgtgttggccaggctgatctcgaactcctgacctcgtgatccaccagcctcggcctggcctcccagagtcctggaattacaggcatgagcaactgcactttgccccttggctctttttaaaaaatgcatttgtttgagagtaatgaatagaaaaggaagttgtggcatgaactatctgattcttcttttcttccactactgggagatttcataggccaaatattctctctagtcaggggcatgcctgatgatgcttacagtctataaagagtctggtcttgttctcctttcatcttctctggagaaaggataatcaacaacagaaattttttaaaaaccctcatactttagacaagtcacattcagccactctgtggaaacactgatttttctacgaggctttcttagagaataaatattaacacatatgcttcatgggctgatagatattgctgtggtttcaatgtgtcctctacagaatttgtgttgaaatgtaatctgcattgtggagatattaagcagtgtggccttttggaaagttattaagtcacgaaggatgtgccctcgtgaatggattagcaccttagaaaggggctggaggaaactagcttaggaccctttgcccttctgccttcaccatgtgaggacacggtattcaaggtgccaccttggaagcagtgagtgggccctcaccagacctcaaatttgccggcacctttatcctggacttcccagcctccataactgtgagaaataaattcatgttgtttataaattacccagcttcaggtattttgttatagcagcaggaatggactaagagagatttaatatggaatcccaaacaatgaaacaactatttgtacttctaaaatataggtagttctcaaaagcattatgttcagtaggatagctctctaacttatctctaaagttaattaaacattatggctgaaaaatgagttttagtttcctctctttgaacttctataaagaaaatatacctttgagacttgaaaagttcagtgctatgaaacgtctttctagggtagtttgggtagcaccaaagtcacctataattaaaattacatattttccattttaaaaattccattttataattttcaaataaattttttactatcaataaagaggtattttttgatttgtgcaactttatatgtagcacttggtttcattaaacaaatgtcattgatttcattagcataaaactttattttcttcaccttaattttgaatacaattaccaaataaaagtagcttttatctttgtccctttgaggttagagatgatatcttcttgatttctctgtctctcccgagcacagtgcccgcacatggtaggtaattaactgtctgttgactggttaaattatctgtattacaagtaaatacaaaatgccaggttttacaaaacactcattccatattgtctatcactcccactctattttatttttcaccatagtataagttaagatattattaaaatattattaagatcatctggggaagtttgctcacttccattcttgaaattattataatctcctcttaagaaaaaactcaaaatgtgtaagagcatctctgatagcttggttcttatttgtataatgggataattttatttcttcagttgccatcctgcaaacactttttctaagtctttaggaacctctgtttttaaattgcttttgcttcatgtgataaactttaagcccgtggccttctaaaatgattcagtcagtcagttctgacatctcttcatctcttcttggtagcaccctcgccatttctgcaacgatttccactgagtcgcatttcagcctgtgtagaaactcatgatgacgtgttgttttataatactttacactttgtgtattttgccattatgggggtgggttaatgtgttataaatgtacaaatgcttgttatcacagtaaattctaggtagagaacagaccatggaaatgttgttttaatttgtgttagtttgagaaaattaataggtatctcatatgacttataccagaaaatttaaaaactataaacatacagccaagcaagaaggcagtcattatgagtattttcagagtgtattgtctgagaatacggtggcgttttccattgctaaaaagaaatgcacagttttccactagtaacttgggagaaatattttttcaggtatacaatgcagggagttacttgacctaaaatgggtacttaaatttcattgattgtttaaagataagtaaataattttcccttttttgccagagttgttttcatgtaacgatacgatacatcttataacaatacttccattataacatgctttatatgtattatctcatttgattcaggtgatgactattttcaatagatattgttgctgtctccattttacagatgttataggcaaagttaaaggtgtgtaggcaagttacattgattcaaagtgatggacttcaaactctttgcctctattttgttggaacattcattaaatcatatagcacctgctatgagtggagactttcaactcataaagaccagaacatttaggggacaaaagtactcacagcacctggaaccaaaaaaaaaaaaaaagaaagaaagaaagaaacaaaaacaaaaaacctgttaaaaatttcttcatcacagacaagactctttcaagggtactgatagccatgggacagagggaaggacaggtaaagttgatgggccaaggagagtaacatcaccttcctcagcctaagctgcaggattataggaaaagctaagtagcctctgggtgatagtacctgcttgggagagccgttgtgtgaattcactttgtaaggtccaaaaataaatgtgacttagatacgttcacaccattcctctctttcccttttttcctgggttacctgctgtccacctagctttgactattgccaatacccaatgcatggatggaatacagtgagaaggaacctgcaagtgtcaatggaggcagaggcagagaacaaggatgagaacaacaaattttaaagaagctgtcttgaacatttggggaatagaggttggtgaggagactagccaagatgttttgtctctctgttgtataacagagtgccctgtggcatctcttatacaggtggctatacagtttttaatcacttttttaaatgttggatgagtatttcttttgattgcaataaacttatggtgagacacactactaggtggcccagttttattcaggatatgtaggagatggagctttataaagctgcattcatgaagattcttacaaaatattctcaggtggtaacattttaatgggtaaaaataacacatgctttcaaagaaaaatctattattcaacttaatataaccagttttatatatacatataatacacacacacacacacacacacacacacacacaacagacagagatactttttgacttacaatagggttacatcccgataaacccatcataagttaaaaatatagtaagtcaaaaattacatttaatacagctaacgaaaccaaatgtcgcagcttagcccagcctaacttaaacataatgagatcacttacctagcctacattggtcaaaatcatctaacataaagcctattttataataaagtgctgaatacctcatgtagtttattgaatactgtacagaaacttaaaaacaaaatggttgtatgggtatttgaagtacaatttttactgaatgtgtattgttttgggggaccgtgtgtatatgtgtgtgtgcgtgtgaattggaacacacacagttgcttttgcagcagttttgaagtcaagatacaacatatactaatattggtttcacaaggtaaaggccattattatccctatgagaattcagtgaggaagatactgcttttagctgggtagaatgaggtagataaaatatattttgattatttgaattaggagtttcatgtgatgagctgcattgctacatatcttatttcttactctttaaagaaaccaacaagcttttcatgtctctattacagaataaaatagagtaatatgccaacatatagacatttaattttgtcaaatccaactatgcaaacttaaaatgaaaggaaataggaggatataacaacttaaatggcatcagcaatttctcacactgtttcaccccaagagtgttagccttagtgaccttgagacagaagaagtgaatcacttagtagatctctttttattgtatgcatgactagaggaagcatcttagggtgctgcatgtgagcattacgtttaagaacacaatgttgtagaagtatttcttgtatattgtgccaggggctttgtctgcttatcagtggtgcaatacatcatccgtgaactaagattttcattttatcattaatttgttatcctgagagtggcaacttagttttacttaagatagcttccgtagttctaagcacacgtggagactccctgttcagaagaaaaagttctatgtatttccatgtattttattaatgatgacaccttttcctaaagtctcccccaaactgtttcttctcgcttctcattagcaaaaatgacatcacatagccaaaccaattcctggcaaggaaaaggatatcatgatcatttacttagatcaaccgtgattcaaccatagacttgtggatgggcccatcttctatgatgcacatggccagtcaaaggaaaattttggattccagtagaaaaaaaagaaaagagattaaatattgattaggtaggtgctgcaacatatttgttcattaatgtactgtaaagcactatttgtatttcacatttatacattcatattactttataagatggtatacataagaccatgtatattgtactttttgggcaatataaggactttttgtagggctaattttgactccaatttttgctatatgatcagagttacactataattcatgaaaaagacaagactcaactctaatatcaatattagccttagtttaccagttatcactatcggatgtgtcataagcatttgtttttaaggttgaatagagaacctgattgggtgctataaaagtctgatcaacagcttaaatgtttgtttgtttgtctttcttaaggaaaatgagcattgagtttctttctgttccacattgaataaacctcaccaaatctatccctacattcagatactcagtccacaaatactgagtaccttctatgtgctgaccgctgttctaaccctcgtggatacagtaatgaatgagatagataaagtactttttctcaaagagctaacattctattgtgagaaaaaaatagaataatcagagaagtcaacaaaaacaaaaaatgtgagatactgaagagcatgtgagagcaggccagtgggtaactactttaggggtcaaggaagtcctctctgaggaagcagagtttaagctgaaatctaaatgacaacaaggagccaccatggaaacaccagagaagtatattctaagcattggaaatagctggtgcaaagaccctcaggtgggaataagcttgaaatgtagccagcaagtgggaaagaggaagatgaggtcagagaggtatgcgaagactagatcatgtgagattatgtaatccaggtgaaaaggattgattttgattctgaatataatggcaagtcattggaaagatccacttgatcaaaaagtgacaaggtaacatactggataaggtatgggaacagtatcatagggaaacaattgaagtacaattaggctgttgtccaggtgagaggtgacggtggggaagaccaaactggtgtagtgaaatgtacaaaaattgaacagattcaggatgtttgggagataggatggaagaagtgaggaaatgagagaacggggtgaactttcaaacttctggcttgagctacggcatagacgatgaatttttctcagagatgtgtaggaagcaggttcactgaggagagagagcaggcagaattgagagttttgttttggtcctattgaaatagagatgcctgtcagacatccttgtagagatgccagataaacagttggatacatcagcctggagttccaggaagagactaggcctggagataagagatttggtagtcatctgcatataaaaaagcaaagaagtgcccacacagttattttaattaattccacagagccttctaaagtataatttggagaactgaaaattgatgggtacttatttattgaaacatttgtcttgaaaatttgttgacaacacaattgctgagaaattaattgatagttcatgacaagcagtgacggctcatttcctcaaagtttccctaaaagacaaagaaagttttatgttattagctttggcttgctttgaaaatttgtttttgcacatcactgttttgggttagcaataaaattctctgcatttgcttcataaatcaaacaaggacacaattgttaaatagtctgtatcatattaattaggctctgaaacaaagcaagcattacagccatttataacagggtattgcataagttgctaatcaatgagaaaagcaactaattaacaagcaaccagtcagcattttgagcagaagttggtgactttcagcttaattaaaccttgcaggtgtcagtgatgatatgaaagaatctttaatctgtttgtgttgaaattcccccagatcattttcacatctgtacatgtttaaagcccctatctactttcatgtaggtaaagggaattcagtgtcttaaaacagttcacatttttaaaagccctattcttaattaaatcattaagatttctcctggattaagacagtggaatgaagttcatcatctatttcactctaaaaaaaaacttagagggctaagcagctttattgaagtataatttatataccctaaagtatacttgtttcaagggtaaaatttaatgattttaagtaaatgtatagagttgtgcaattatttccagagtataattagaataaaggaaattttaaagtttggacaaatttatccatgaggtatcaaaattagcttgtgagggaggctagatatacctagcctttaggaatgacctataaaagcactgatacatctttccttctagccttcaagtgtttccaaccatctgctacagctaccatcaaaaacaggattctaaatgggatgaatcaaggattaagagtaatctattccttaaataacttttaaaataccataaattcctctttaattacagtagattatttggcaaaattaagaatactagttcctcaggctgccttttttttttttttaacattaagttccggtatacatgtgcagaatgtgcagtttgttacataggtatatgtgtgccatggtgccttgctgcacctattgatccgtcatctagctgccctcccctaaccccccatccccccaacaggcccagtgtgtgttgttcccctccctgtgtccatgtgttctcattgttcaactcccacttatgagtgagaacatgcggtatttggttttctgttcttgtgtcagtttgctgaggatgatgctttccagcttcatccatgatctcattcctttttatggctgcatagtattccatggtgtatatgtaccacattttctttttccagtctatcattgttggtcattcaggttagtttcatgtctttgctgttgtgaatagtgctgaaataaacatacatgtgcatatgtctttatagtagaatgatttatattcctttgggtatatacccagtaatgggattgctgggtcaaatggcatttctagttctagatccttgaggaatcgccacactgtcttccacaatggttgaactcatttacatttccaccaacagtataaaagcattcctatttctccatagtgtcaccagcgtctattgtttcttgactttttaataatcgccattctgactgtcatgagatggtctaagaaaaaagaacaaagctggaggcatcgtgctccctgacttcgaactatactacaaagctacagtaacgaaaacagcatggtactggtagcaaaacagacatatagaccaatggaacagaacagagacctcagaaataacacccaacatctacaaccatttgatcttcaacaaacctgacaaaaacaagcaatggggaaaggatctcctattcaataaatggtgctgggaaaactggctagccatacgcagaaaactgaaactgaaccccctccttacaccttatacgaaaattaactcaagcgggattaaaggcttaagtgtaaaaaccaacaccatcaaagccctggaagaaaacctgggcaataccattcaggacacgggcacgggcaaagacttcatgacgtcaatgccaaaagcaacggcaacaaaagccaaaattgacaaatgggatctaattaaactaaagagcttctgcacagcaaaataaactatcatcagagtgaataggcaacctacagaacgggagaaaatttttgcaatctacccatgtgacaaaggcctaatattcagcatctacaaggaacttgaacaaattttcaagaaaaaaacaaccccatcaaaaagtgagcaaaggatatgaacagacacttctcaaaagaagacatttatgtagccaagaaacatatgaaaaacagctcaacatcactgatctttagagaaatgcctttttttttttttttttttgagacagagtcttgcactgttgcccaggctggagtgcagtgacatgatcttggctcactgcaacctccacctcccgggttcaagtgattctcctgcctcagcctcccaagtagctgggaatacaggcacacgccaccatgaccagctaatttttttgtacttttagtacagacggagtttcacaatgttggccatgatggtcttgatctcttgacctagtgatccgcctgtctcggcctcccaaagtgctgggattacaggtgtgagccactggtggccgacccgagaaatgccctttttttaaagggatagttctctcatggctaattcaaggaatacaaggattctttcataatgataatgtctctatttcttctcggttataatctctgtgcaagatgatgtcattttcaaaaagttggaaatgggcaaacacttgtatttgagatttaaataagtatgcatataaaaaatatttgtcatattgagcacattacaacaattatttcaaatttccaagagatggatgatgatttgttgaatggaagtagaaaatattaagtaaaatagcagccatcactttctatgtgccagaaactgttctgagcactatccacacacttaggacagtgccttaaacactgtatatgtagtagttagaacagatacatgtttacatgtaatatgggataggtatgggggaatggataatgcttagaaccatcctggcacatagaaagtgatggaaaacagttcttagaacaattcctgggacatagaaagtgttgtaaaaattaaatgtgggtatatatatatatggaatatgcatgtatatgtgtataaataatatatgtatatgtgtgtatgtatgtataatatgtgtatatgtgtaaatatgtgtgtatgtacatatatcattatacattttgtatatatacatgtttacgtatacacatattattacaaatgtttgctctatataaataagctatatgtgggatatccaatataaatatctattctataagattgttgtaaaaagtaaatgagcatccatatgtacatgtatatacacactcacttcatttttacaacaacctatgaaataggtatattgatcctattccagaaactaagaaactgagcctcataaattaaacagtttgctcaaggtgccccaaatagtagcacagcggggataattaacacagaaagtcaggctctggagtcattgctcttatttaatcagtatctcctactggaaattttgattatcaatattgttcatatcatatggcttcaattgtttatcattagtgaaacctacaatgtttcattcagtgttccaatctaataaaacaatttgtgtctgctctgacatacttctcttaaaaatgtcaggtattttcagacacattggcaacctggtattgtggaaggagtggtaagtttggaatctggagacttaggttagaagtgatagatcttccaacagatcattgcagagactgggaaattatttaggctcaccaaaccagttatctgtaaaatacaggatatgttccttgaccttatacctctctgttgtgccttcataataatgagacagtagcacttatattgcctgagagtttctgtttacttgagtatctcttcataaagtgtaagttctttaagggcagggaccctgtcttttttactttgtgtcttcagcatcctttaggctactccctgtcgtctcagaagcacatactaaataagtgcagaagcaaactataaaagaagagaaaatatcatgattcccaaaacagttttcatcaggatcaaatgtaaatgaaattccgttcctgggctcttgctaccagctggcctatgactaaaacaccaggctggtgctgcttctagtagcaatagacattgactgaaaggcatggaagcaacctagaaattgcattgattgtaaatattttcaaatgaatatcttgaagaatggattcaaaacattccattatccatctatggggaaaatatttgcagcctctgtatatacctttattttgtgtttctgttatctcttagagtctttcaaaattgttgatcagagacaaagggtggctgttggatcataattgtaaaatgatggacatcagaagaactatttagttaagtaatgagagaaggagcaagtcctgtagaacttagttctaggatatcacacagcacatttcaggactcttctttaaatccttaaggagaggtcttttcatttgcctgacgaagaacatgagggaacaagcactttttccttgaaatgttttttgtactgatcagatctgctaataacgcaacatagacagactaccaggaatgcaactgcttatatcctctctgttcacaaaacattgcagtgcatttgttgtgccttcattttcctcatcagaactcagagctcatgactttaacccttttcagttttggaatcagttgtttctaagataggggctatgctttgtttctgtacctggtacttttttcccctggcataaatgaaaatatctcttcaaatatgtacccaagtagtagtaatatactctgtcccagtccctggagagctgtacaaactggaggtaagccagtcattcatttgattatattaagattcaatgtttaaaagcaggacaatgccataccatatgaaatcatattttacttctcacttactttagctcagttactttggtgatgcagaaagtggttttgaatttaagataggcattcaggctggaggcaggggctcacacctgtaatctcagcacttgaggaagctgaggtaggtggattgcctgagcacacgagttcaagaccagcctgggcaacacagcaaaaccctgtatctatgaaaatacaaaaaataagccaggcatggtggcatgtgcctgtagtcccagctacatgggaggctaaggtaggaggatcacctgagcccagcaggttgaggctgcagtcagccatgatcgtgccactgtgctccagcctggggaacagagggagaccctgtatccaaaaatatatatatatatttattaagggtccatagaaatctaggttatagaataggttatatcataaaatattagcctcataccttcattctactcataaaagacttagctgtataaaataaatattgccacaggttgagtttaatgctttctaattgcttggctttcagtgaagaatctctttacacaagaatgtccttgtgtgcggaataaatcggactttagaaaatctgaaaacctcatttacacagaaatatgcacatccctggactctatacagcccccctcctgtgtaattattcttcctttgacacaaagcactctaattccagaatgcctgtgttaaaaattaaagttggttaggtgtgatttttcctttcggatcctcttctggacattgaacaaaaggagactatacatttaaaagacacaaacctaaacatgaagtaagaaagacttgaaatttggctctagaaagtacatatttgaggctgagtaggttattttaactcaccaaatcttaatttcatcctttgtaaaatgaaatgatgaaaataatacttgccttataagcttgtctggaaagttgacttagacaggtcctgcaaaaatcttggcatgttcgtggacacatagaaagttctcagttaacgttaagcaccccctgttctcgcgtcttcctcctcaccttctcatcgctgatgtatatgaaagtataacatgcagcaagggaactagactgagtctgcctcaacacattctggaaggaagtattctgttctgcctatgctcctttccacaagttttattctaatcgtcagatgtgttctacttcatctgagtaattgtttgtgataacacctggagaggtcttaacttttgtatcttataaaaacaccaaacaccacatgttctcactcataagtgggagttgaacaatgagaacacatggtcacaggtcacagtaaggggaatgtcacacaccggggcctgtcggggggtggggggctagtggagggatagcattaggagaaatacctaatgtagatgaccggttgatgggtgcagcaaaccaccatggcacgtgtatacctatgtaacaaacctgcacgttctgcacatgtaccccagaacttaaagtataataaaaaaattaaaaataaaacaccaaaatattaagtggggagtgacttaatgaaccccatggaatgagaacgaaatacaatgtatatgcatttaacttgtacagttgtaagcagcatttttcagtgggctgtgatattaattccatttcacaaaagaatttgtgagactctcaagcaggtatggccaagagaatgatcctcattctgatttagcttctcagaagattgatgttctctctgggatcttttgtgtgtccagcatggtacttgcagcagaccattatgtgctgtcatgctgcttcttgatatccagactcggtgtgctctgcagaactgcagcctcgctacatgtttcagtgcaggaaattcacattaagggatccttttccagagagattgctcaggcaatttcagttccatctctgttttaaatgttggaaaacaccccctttctctcagtctacccttgctctgcatgcctatcttttgctttgctgtttctagattctgcgtttggttatgtatcctgtactcactatggcagtaggaggagatttaatatttattaccttttggtgggaagaataacttccagatgaaagtccagctgaaaacatagtctcctttggacaagaatataaagacttcagtctgccagagtagcattactagacacctggctgcaggaaatgtgatgttacttttttgacatctctgctcactgcaacttctgccacccgggttccagtgattctcgtgcctcaactccccaagcagttgggattacaagtgtgtgccaccacgcccagctaattttttgtatttttagtagagatgggttggacaggctggtctcgaactcctgacctcagcccacctcggcctcccagagcttgctgggattacaggtgtgagccaccacgctcagctggacaagcaagttttgaagcagaggagttgtctgcaaaatctggaatatgggggcagttatggagaaataataattagtactgttcattgaatgttttaatgtttgccagaccttttgagttcttcatatacattatcttagcctacctaaagcaaccatgtaaggatgtgtgttaatatatccatttacagatgaagtaatggaaactcagataagtagatatttcatgcaagatcacgcagctggtgtggaaaagctgagatctgagactggtgcactctgactcaaaagccagcactcttagggattagatttccttgtgtgaaaaataggtcatatgagaatgatggaagcatatagctacttttctttttcaccaaatactaattctgcatatacacataataaagtagtttttctgtagctatcaaggacttacctgaaaaggaaagggtgacatcagaaatccatgctgtgttgtgggggcatatttactctcaccttaataaatgctgcaaagcattatagaaaactacttccctgctcatggtaatatgacaaaatcctttcatcttcacgtttttcaaaagtgatattctggtgggcctgcaaatagtaaatattagcttcttgaaagatcctttatggagactaatttttttttttttcatttttattctcatggtttttttccctgattttctaccctcttgttttgcccattcatggtccatatatttttgtcattttaactcctcatcctgaagcacagcaatcatttctgagttttatggatcaccgcacagatattctggtggtaggcgattaatccttatccaaccacacagcagttttacctaggctttgggatgatatttagctgttactgtggagcttcctactggaatctagagaacagaggggcaggggaggtcagaggataggtaaacataaatcaggtttgtgcaaacaagcatgatgaatgctagttcccaaagtgctctgccttttgtcaaacttatatattaggagagagggttgtgtggcatgaatgatgaatcataaaactgctctctctggtgaaagggcaagcatagaaaccactgtagtaacacggtagcttggatgcatcatagggcttgggaatacagagtggaaaacagtaatatgtgtatcagcctgaatgaaacagtaaggagaacagagcagagtgtcccctgactaggaaatccagatcagtcaaaaggaagtgagtttggagaagcaaaacaagatacagtacgtcagggtttcttaaccaggcctcacacatagaaaaaaacaaaacaaaacaaaaaaaccctgtctgttcatttaccatttactgaaatttagctgtttcttcaattattaatgagataatcatggaattttgatcagctacagtggctttaccactaccagaagtaactgattgatttcttcatatatatctcaaaatattgtttatgccattcactactttgaaatttcagtagctattacattcaccactagaaacatatattttattacaaaatttaaaaatacttttaaaattgttcttcagtataaattgttgtctttgtaattctgtgtatgttattttatgcactagaaaatactatcctgaaaaagcattcataggtttcaccagtacactaaaagggtccaggaaagaaacaaaaagtgtgaactcttatggtcgatatgctgtttttaatgttaggtgagattcagctttttaagaatttaatttttagaaagcttgagagagaaaaatttctactttgatatattcagtacaatatattttgccacaagtcagcatctaccatgaataaaaattaatttggggactaatgccttaccttctacttgtcaaccttgcaacctgcctgtcaacatgagaccatggcaagcttttcagattaatcagtgctaattcagctcccatttcctttacttgtattatacagataaagtttgcaatgagattaagagtcttggctcttaattggaatttctgattctttttttttttttttttttttcgaggctgagtctcaccctgtctcccaggctggagtgcagagaagtgatctcggcacactgcaacctccgcctcccgggttcaagcaattcccttgcctcagcttccccaatagctgggactataggcgcatactaccactcccagctaatttttgtatttttttagtagagacaggatttcaccccattggccaggctggtctcgaactcctggcctcaatgatccacccacctcggcctcctagagtgctgggattacaggcatgagccactgggcctggcctctgattcttaattttagctgtactacttaattatatatgtgaaactagatatattattttatctccctaagcctcagtttactcataatgtgagtaataatagtagctaccttatagggatgtggtgaaggctaaatgcaataaagagaacttaaaacagtaaaaatacatagtaagagcttaatccataattgccagtattgttttcagtacatactgtaatcgtgcttaataagaattgtaacccactgccatcttcatcctccaaaaaggtagtgggtctctaaaaatccatgcacacctcccacaacgccacaagagcagacttctgggaccctggacatcttgggacctcttcataggatggcttgtatattctattctaaaactatttgcattaaatattaggtcaatatacaagaatacttacaaagtatacctaaggtataaagaataactatgtaacagatacttaatgacagtttaagccaattatcatttaccattagctctgaaatttccagaatgctcctctgtgataccagtctcttccctcccaagtgtaaccatgatcctgaaatttgtgtttattattccactacttttatggttttgccacatgtatctcccaatataaactttgagtgaatagagttacgttgaaacttgtgacttgcttctttcactcagcttaagttcctgagattcatccatgctgctataactagatctgtttatcttattttcacttttccatcattatttgtgaattggtattctataatttgctatccacttactattgatatcctctctttttttgctattatcattaatttctgctatgaatattgttaaatatgtctcctgctgcgcctgattctaacaagtagagttgactcatgaggtatttatatcctcagcttcacgagataacactaaattgtttttcaaacaatttttgttgttacatttgttctaccagtatcgaattgttcctgttctttcacattctggacaacacttgacagtgtcagacttttgcctgtttgacaatttgttgagtttgaaatgatatctcaatattttaatttgcaattagacgtctccttatttggagaagttctgtgtattctgggcactatcttttgccagttctcttgagttgcacacgtattctcccagttgcttgctggccttttcactcttatttggagtcctttgatagagcagaagctcttaatattaacatagttgagcccattaagttttttctttatgattgtactttgtgtcttctatcttaaaaatccacaatctaaggccgaggtgggcggatcatgaggtcaggagatcgagaccatcctggctaacacggtgaaaccccatctctactaaaaatacgaaaaaaaaattagccaggcgtggtggtgggcacctgtagtcccagctactcgggaggctgaggcaggagaatggcgggaacccaggaggtggagcttgcagtgagccgagatcgcgccaccgcactccagcctgggcgacagagcaagactctatctcaaaaaaaaaacaacaaaaaacaaacaaaatccacaatctatttttcatatgggtaaaaaggactaaataaaatccccttatatcatttaagagggaaaataattacccaagaggagaggaaagaattggattggcttggaagtggttatttttacattttttcatctgtagctacactgtgggtagaaaaatagaaaaattacttgtgataacccagattacttagcatctttagataataaaagtttactcttactgtggcattcacctctaatttaacttcatgagtctgttttcttagtcaactgtactagatgctagagatacaaaaattgttacgaggaggaagcaagcgtctaggcctccacatctggatagccattctcacatttaccacatcacagggatgccatgcaagggcagtacacagaagtttatctgtgtttcattttataatcttagtattttgtgtgtccatactcagtctgcccttggttcccactccccactttgctcttctttgtatataatttgatttgtgcctcatcttcttactagtctgaacatgttgttgaggtaggatatccaaccatcctggtttggctgaagttgggagacctcctgggatgcaggacttttagtgctgaaaccaagccccaggtacctgggacaaattggtcaccctactttgagggcaaggactatgtatgttgcatctttgcaccatgtacaactcattttacaatgtttacacatagacagtagtttttaaatggattttgcattaagttggaaggcactcagttctgacatggatccttccagtcattcttgcaagttatgtttattttctagcatctgatttcatgaagctgccatttttcttagacaagttgactcttttttcttgaatccactgaccttagggtagcagtaaactttgtttaccaacagggctctgtcatccacatgagggatgttgccattaagtgtctttttttttttttttttttttgagatggaatctcactctgtcgcccaggctggagtgtagtagcgcaatctcggctcactgcaagctccgcctcctgggttcaggccattctcctgcttcagcctcccgagtagttgggaatacaggtgcccgccaccacgcctggctaattttttgtatttttagtagagacggggtttcaccgtgttagccaggatggtctcgatctcctgaccttgtgatctgcccgcctcggcctcccaaagtgctgggattacaggcgtgagccaccgtgcctggccaactgtcatttttccccacaaatgcatcaaagcttgtttattaaaacaaatttattatgaatcaggattaattaacagattaacatttaacatactttaattgaagatattcatttagattttgttctgtcgtcaagtaatcacaaaagttgtagttaccaagttttctgccattgttgaattatcctggaggtcacatttttgtgtacaaattgatgagggacttgcttcgtagtataatttgagaggtggctgaactggcttctatagctagacatatttccccttttgggctagtgagtgcctccattagttgtcaccccttccattgtaagccgtttttcctcccgcattaccttataaaccacaaatgcctggaggagcctcagcatattaagacagttttgatcggtaccccttttagcagaagttattttttcagctgctttccaaagtaacagatgagagggaatttgaccttgtgaaagcaattgtgaggcagccaggtaggaggtgccgcaggaacactgagcagcaggggcaggaggccgtagctgtgtgtgtgtgagctggagtaggacaccttaagggaaatggctttagggatcaactttgctgttccacagtgctgtgaccttgggcaagagaaaagtctttaacaggtttgatttatgagaatattttctactctcgatagaatgcagtggatatctgatgcagttttgtgccatctaagtgactactgagagaagatttccaaatttctctgattgccatcagtagggagtgatgaagtgggattttcttttctagttgcctttatccgtgtcggtgaaatgagaacaaagctctctattctctcaatttagaaagaaatcagatctgaatctccaaaatcagttgaacatccttcaaccagtagttccgtgtctgatgtgtagacagtggtaactgccatactgaaagaaatgtagtcttgtgataattcagaactggacgtaaccaaaaaagtggtttttaatcacaaaattattttctggattgtaacaatttggaactggatataacccaaaagggtttttttgtttgttttttactcatgatataatttgtctgagaaaagcttccccagttgtgtggcaaataggttaggaggcctatttgagtaaaaatccaactgctgttacagtggaccttcagaataatttaatttggtcaattgtccatagctgtagtgaaattttgtcttaagaagcggtatctgaaaggaacttatgttacagactgaatgtcccccctcaaattgaagccttaacccccaaatgtgactatgaggtcataagggtgtggcaccaatccaacaggattgccgtctttataataaggggaaggaacatcagggagacatacacagaaaaggccctgtggggacacaaagagaaggtggccatctgcaagccaagaagagagccctcaccagaaaccaatcctgttggcacctcagtcttggacttacagcctccagaactgtgagaaaataaatttctgttgtttcagcaacccactagctggaattgtgtcacggcagcctgagcagactaatgcagcatctaattttaaaaaaatacttttcaaatattcaattttcccaagtccggtgatcaccacttggtttctgaatttgattttctattttctagtgaagaattttaccctgttccttcccgttctaggttcacagactgacttctggtccttgctgggggtgctgccagccttggaggctggtgagttgactttataagaaaatagaaaagcctaagttacagcaccagctttcttagttttccacagttcatggttctcctgtaggccactaatattcctgatacatctctctagcttttgtcataatcaaaatcggttgactgtataatacgtggtgcctgcttgcactgatgctgtgttattctgtttgtttgtttgttttctaaaggggaatcttgtagattactagagagttcatgatactctggtatcagttatgccacaaactagtattaatccatggacatttcccgccagcccaacctgccgcagaaactcaatttgagggttttctctatgtttctcgttaatataactttcatcctctgctaagttatcatttctctttacctggagccagaaaagtaggaccctgagccgaatctgcctctctacctgcttttgtaaatgaagtttcattggaacacacaaccatattcattggtttatgtgttatctatgactgttatcacacaacaacagcagcattgagaagttgtaaaggagcaaaaaaagacacagaaccatctgaagtctttgtgcagtggctcatgcctgtaatctcagcactttgggaggccaaggctggcggatcacttgaggtcaggagttcaagaccagcctggccaacatggtgaaaccccatctgtgccaaaaaatacaacaaaaattagccaggcatgggggtacacaactgtagtcccaactactcgggaggctgaggtgggagaattgcttgaacctgggaggcagaggttgcagtgagccaagatcctgccactgcactccagcctgggcgacagattgagaccctgtctcaaaacaaagaatctgagcctaaaatatttacaatctgtatatctatcttactaaaacatatacttaaggaaaaagtttgctgactattgctttacgttacctattggcttgacaagcccaatacattcccatttcttattagtacacgaatcataaataatactgagaaactataacttaatattgttaaatcttcttctctgtaattatagtaaaatttgagaggaattagtatggtatatccctatctgtttattaagggagtgtgtgtgtgtgtgtgtgtgtgtgtgtgtactatatgtttaataaaatcttaggaatactaggatttgttgagtagcgttcttatttaaaaaatgtgtaaaatttaaaattatgtaaatattcataatacagaagtcttcttagctttaaagatttacctgggtgaagacaggcattgtctgtacttgatcaagtaaattttcagttcattcaaaatgtttattttgcttgcatcttaccaaacctcaacttatagtcagttgaccaagttataaaagttctctttcattcccatgagatctcaatctatattggtggaggtgggagtagtaatattataaggcaaaatctctcatctgttctccagaaattaagtcttaacaatgttttctaagagcaatagccctgatgcagtgcttaatgctttatttccatatttgttatttctgactgctagaaagcaaaggtcactaggtcaggaaattagcttaagggggaaaaaggaaagtagttactcttaaggttaaaatccatatagtatgatgggttattgtgatgaatatttagttttgaaagacttcatttattatgtaatagccatatgcagttaacagaatgcttctgttagtgaacctcacaaatgatttagtaacccccagagattagctggatgttcatatgtagtagaagaagaaagcaaatttgacattaaaaacaacacataatgcaatgaaaacaaaataccccttaagagttaccatgtactatacaagacccaccagtcatccccagtaccattcagagcatgagattgattcagtcatgtccaccatctggttctataccggttttcaagtcccaatgatcatagttttgataatgtaccaggtaccatattaagggcttcatatgtaaataattttaaagtttttttttttaatttgaagaaacagaagtcaggttaacaaatatgccttaggtaaagtaaaattcaaaccaagtaagtaagagttcaaagtttatgcagtattaaaaatcatttctggccaggcatgatgactcacacctgtaatcccagagcttcagaaggccaagatgggaaaatcacttaaacccaagagttcaagaccagcttgggcaacatagggagaccgtatctctacaaaaaaaaaaaaacaaaaaaaaacaacaactaaaaaattagctggacatggtggcgtgcacctgtaatcctacctacttagcaggctgagtgagaggatcgcttgagcaaaggagttcagggctgttgtgagccatgattgcactactgcacttcaccctgggggacagagcaagaccctgtctcaaaatacacatacgcacacacacacacacacacacgtgtgtgtatgtatgtatgtatatatatatataaactttgtttatgtctctcctgatctgtaatctcttaaaagacagagactgtatttttctaattgtttaattcccctagtgctcatctggtacattttctacctagtgcagtcgtatcttatttagagtctcatttctaaaaactgtgcatagacaaaattggttttcaaaaccttttaggtaaagcccatgttggagactgacatatgacatttcggtaaacccaacacttctgattttcttcataacactggaaaaatatggctgtttttcagttgagcattagataaaggacttttcctatcctcaggggtcatgttgtacgtaaaatatattctttcatacaccagaattacactcaacatgacattgagaggcatgaagagatcaagacttactcaaagagttgcacatttatgtctctcttctcatgctcactgtggggcatagtattgacattgagagaaccctgaacagtattatccttgagcctcttagggcgtgatttaactcacataagttaaattcaccaatggtgccaaaatattgtaccaaatagagataaagacctcacattcctttagcacttactatatgccagccacattgaatgaactctgcacttaataattctcatgacactgcacaaggtatatgtcatcactgtctttgtgttatgagtgatgaagctcaggtgtgcctcagaaaagctgagtaaattccccagggttgccctgccagtgaatgccaaaatcaggatttaaagacctcaaatgcttttaactatctagctttgcattttccttaagaaatgttgattgaaaaattacaagtaatagtatatataatttatattttgtatatataatttatatatacatttatataatatctatttataacatatataaattatatatacaatctaaggttgtacactatctgcctttcgcttcaagttgatttttataaatagtcttctccatgttgtttctatattccaaagaattatttaaggtagtaaaatcatcagccatttgtaaataggagtccagtcatgcaaaccttagctatagccccacgaaggctacaacagctgggagcactgttcacataaaacacaacataaatgatgcccccacccaggatgcagaacaatcactgcccttgcctgctagctaggcactggattcatcaagaacattttaggaacagataaactcctaaaactctttatcacacttcattagttacattcagtgctatgcgtccaaattctgctcctgtacatgtttaataaacagagatgtctacacattgtctgattgtaaattgtgaggatttcagcatggtggactttgggtccataaacacataggcttctcacgtttatacagaaagtcaagcttgatttggggcttaaatccattgtgaaaatgcagtagatcttttaattaggtgaggatatttctaaagacatctttaatgtctattttattagtgatgataatgtaatcacaaaaacagctaaatccaaaatatcctctccacactcatagtagtccaccgcctataaaggtctttaagaaagcagaagcacagtgttcataaccttgctggcatgaggttaattcagaaagtcacttggtctttgctcttgacctcaaaatctacctcctgttaagaaggagaaaaaggaagaaaagcatttgctcgtcacttgtcaggaaataaaaggaagaaatgggatactgagagtaaagtagtatagtggaaacacgcattttctattttctacttaaagttccattacctttcaacattgttgatattgtagatgaagaaatgcttgcctactctctacaaatgatatcctatcccttacaagaacagataaacatagtggttgggaaacaatttaaattgtttctgagttctttggaggatttcatgtaaattcattagtaactctggaactatctactatgcatttaaggaattaaaaatgtattagtttcactacacaaatgtattagcttccactctgtagttaaatgaaaaatgtattagcttatatgtataaatatcttaacattcagtctgtagtattttctcttagatattactccatttgaactagtctataatgcaaacactgcttaaagtctcaatgctggagaattacactttttaaaaaattttcttaagtagcagaaaatatttgtgtatgcggcaatatttgtttaatatagcaaataagtattccttcctaaaaatgctctttcagaacttattcaatgctataatagttttggaaactgaagaaggatattactttttgaaaaatttgaaaaaatgctttcagaacttactcaatgctataatagctttggaaactaaagaaggatattagtttttgaaaaattctagggccgggcacagtggctcaggcctgtaatcccagcacttggggaggccaaggcaggtgggtcatgaggtcaggagatcgagaccatcctggctaacacggtgaaaccccatctctactaaaaatacagaaaaaaaaaaaatatatatatatatatatgttagctgggcgtggtggcatgcacctgtagtcccacctactccggaggctgaggcaggagaatcgcttgaacccgggaggcagaggttgcactgagccaagatcacaccactgtactccagcctgggtgacagagtgagactccatctcaaaaaataacaataaaataaaaaattctataaatgattacatacattaaccacttgaaatctaaaaaaaagaaatccagtattggggtgaagattttattcttagtagaaagacctggtatgtgccactcagttattgaagggattcgtttcatgtagtaactaaatatagatcagcaagacagatatctcggaaccatctaggggaatttgtaagttttcatcgaattttttttttctagtgagcgatgttgctgtattacacttaaactgaaacctattcactctctacgcacctgttcaatgccaccactctggataactgttaaaattcctttccctctatatctccttgaaaaatagcctgttacatctgatgggtcaatctgacaatctccaaagaaagataaaagtaaagtcaaaaaaggacagtgtgagatattgagataccaaactgtaattggaaatgaaaatattttctcttcatttttctggttctcccacactttttcctctattaacaattttagccatgccttatctcccatttaactgtaatttgaaagtgaaaaatctgtgagtaaaaaaggtgctgtttgtgtatatctacataaacattcatgcatctctatcccccatgtccagtggctccttcaccatggaataactagatcccaattttctgttcctttgtctttcagttatttttggaagctttcacaagggcgccttgaatgtgcccacagcaggacttgttagttggaggcaccacccagcatctgccctgctcattgcctattgtggctttttctggccatgttcagagcttgctcttggatcttgatgaaattgaaactggccagattgtcccatagcactgatgtttatggtttctttagaataaacatagaaactgaccctcccagtcttaaaacttgagaaagttacgtttgttgagttcctttctcaggaaaccaaccatcaggtctcccagatagtttcaaggaactgaaacttaccagatcaccacctctggacaatgagacaccagacccctcacgcatcattattgcctaaccgagcacctgcttcctgtggaccaacttctcttccttactcctccctaattcctgttttcccacataaggttacatttcttccctgctatataaacccctaattttagttggtgagacagatgaatttgagactgatctcccatctccttggctgcagaacctgattaaagccttcttccctgacaatacttgttgtcccagtgattggctttctctgcagtgaaaagcagaacctagaccaaaccccaaaccttggcattttggtattggtaacaaaagcttccaccacctattaggaggaagaggacaatagagctaattccacatactctaaaaactttacgtcatcaggcatcagaatgtacttcatcccctctcttctttggcccctctgttactattgaggaacactaattatgcttatgtaaattagacatagaagatagaatatttattgcctataggggctgtgtaatcattttatagaagtcagacacctacaacctgctcacctggggaaaaaaacccaggaattatttatctctactctttaaattatctgagttaataaacacatctagaattgaagtgttttagaaaataaataaaagtcctccttaatgcatttttttattggataatctccaaacttcccaacccaaactcatatctgtttattactttataactgtatccccactcctaatatgaacagtgaagtccaaataagcttataaaacccaaacaaaattacaaacaccaattaccaatagaggtagataaatttttataagcatcaaattttatgaagagtgttttctagtcatttaaatgtatttgctgctgaaggacaaaacagtattaactatctcaaaggcagtggctttagaattgacaataccctttcatatacatctctatatcagtttttaattatttgtaattatagtgcatagtttccattttcttttcctctttctttctttctttgttttttttttttttggtttttttttttttttgagatagcgtctcactctgtcacctagtctggagtgcggtgagtggcatgatctcagctcactgcaaccttgactttgagggctcaggtaatcctcccaactcagcctccctagtagctggatctacaagtgtgcaccaccacgcctggctaatttttatatttttagtagagacagtgtttcaccatgttagccaggctgttcttgagctcctgggctcaagtgatctgcctgctttggcttttcaaagtgctaggattacagtcctgagccaccgtacctggcctccattttctttacatacacaaggtgcttaaaccatttttttaaataagctaattgtagaggtacaatttgtaagtgaatggattaacaatttgcccatagttacaagtttaaaagcaaaatggattctgattccaggtatggcttccaaattctggcttttttaaaactgcaaaccatgatcaaagttagattaggcattcgatgaagagtcctcctttcaaaaggagccctcctttgccttatctctgaaaccagcagagtacacacacttcagttgctgttcttcaggttgtgcaatacaggggcccaagtatgtcaccccgtgattggtccctgcctcaacaagaaacatcactgagctctgaaggtacctctgctgtctgtgtctcttgggatttgaattcatcctcttgattattactgccctgcttattcaactcctataaatcctataaagcctgtatgttttaccatagttgtcaccacgcatgtgacattgggttatctgcctaacctctgatgtccctctagatctgtcatctaatactcatgcctacccttgcctaaatgtattttctacatttctaacttccgattacagacgcttcccttgattgactcttcatcgaatgcctaatctaactttgatcatggtttgcagttttaaaaaagccagaatttggaacccatacctggaatcagaatctattttgcttttaaacttgtaactatgggcaaattgctaattccttcatttataaattgtacctctacaatagaggtagataaatgataggtctttaatgagttacatgtataaactgccaaccacagtggtggaatttataggaatttaacaagtgataattattgttctcctcttgcttgactttaacttccaccttattggaaaaatttttccattaacttctaccttaatgcccattctcacatggcttcagattcatgaccctgtgcagattctttaaacctgttagtgctcttttggatccttgataatagcctttctctgtttccagcctcaccttcaaactcctggtttcatgtgattcagtgttgtgcccctgtccccaacagagctgtagcaataaaaggtttccctttcaggaagatgtgaatatgccttaaacctctttaagcccttaaaatgtaaatcgaattttatttgtattataaagaaagttgcggtttacaaattgaagatttctgtaatgaagaaacatttatctttttttttttactttctgacacacattcagacatgtcattagcttttttaaaactgcaataatcaataaactttgatacttacctattttaattctattcacaactcaaaaactgtatcagagtgaatttctttatatgaaaactaatatcgttgatgaaaccatttagctagacatatacagtgtgatgactaacaggcatctcgaagtcaacttgttgacctgacctcctctttttctcccccaaacctgtgtcacctgcacatgtccccatttcagataatgacaacttcatctttttcattgctcagaccaaaaccttaaattcttttaaatttgtttgctttctctcatgtccctcagccaatatgtggctttacctttaacatatgttcagaacccaactattagttctcaccaccttccatgctaccattctggtctgagacaccagcaagcatctttcttctggaatattaaaataccctcctcattggtctgccttttactccctacaatctattttacaatttggtctcactgcttttcccctttcctcctacactgtattttcaacacagctatccgagtgattcttttaaaaagtaaaccagaacacaacattcttttttttcttcaaaaacttgcattgactctccattttactcagagcaaagccaaagtccttctcttactctgtcatgtataacctgcactgcatccctcctcaactatctaactcctctcctcctaattctattctatgatattttcttctattcctatttaattctgtcctagttccactggtgccctgccccacctgttaacatgccaggcttgcacctgccatcaggctatggtctactactccctcagatcagtgcttgcccaactccatctcttcctcaaaaatttgctcagacctcaccttcttaatgaagctattctaaacacctatttcctactgcatcttacgcacttccctccacattcatggagctcccttaccctgttccactttttctttttttggtaacatttataaacttctaacacactatgtattttgcttattatatgtttaataaattcttcaagggcatgcatctctgttttattccctgagaatagtgcctggcacacagcaggtactcgatgcatatttattaaatgaatgaatttttctttgtctgaaataaatttatttggaaaatatttaacacatttgtgttttgtttagttggggttttgttactactgctatttctataaaaggttgaaatacagaagggaaaagaaaatctcaccagctatctggccttgtacagataaagccaaatgattgaatgcttgactgaattgactggttgtttggacatattttttgtaatagcttaaggaacaactaagctatctgacttccaccccctttccccgtgctagggctagaactgtcaaaaaggcacataatacacatttgggttttaaagaatttagttaattgaattcaatgaaccaaaagtacagtgaaaatcatcaacatttatatgtaaaacaaattctgtttttgtctggcttaaaggggatgtagctgggggctaaaggattagaaatgagtaagagaataatctgacattgctttgcttttcatgcaagctttgtaagctctcaaatggcaatgttggagaattcattacattgtggtaaagtatgacaagttgaagagtctaaattgagtaacaaaagcaaacaccaacatattatacatgaaaactgctgttgaaacaacagatcaaaaactgtactctaacactgtagcactttttatatttttctttattcagagattttgtaaggctgtttatgggttagcatggaaggaataaggctttctaccaaaagcagacacacagtttttgtacagaaatatgtctaccagggattatatactgaggaaatggtgaattgatggaaagaatacgataaacaaggggggaaatgtagtaaagaatcagtggttacctgatgcagttctttaagaaaaggatgattgggtagtgggaacacttacaaagctaaacagtgactgtgagataataactggacacaagaacagctctttaatatctagtgagtgtgtgtatatgtgtgtgtgtatatatgcacacatatatctttcacacactgtgcacatacacacacactttgtatgaggaaggtctatgatcagaaatactaacatcactattcaagccttgatgacagattttccactcctgtgataattcctttgtagctgattgactttggaaccagagagtcccttctaacaatgcagctattcctaggattataggttctcatcaatacctctttttaaatgtgtcacatttgtcaggtcacttttctctctgaaggaggcagtatcagagtgctggacagaggataagaggggaagagaataaggatgattaacaggaagagaaaaaaattggagggaggtcataaagattttccttgatttctcaattgtgccttggcatggaactaagacaaattctgccagatcacccattaaaagtcagtgtacttaataccctcaaaattaatgctatatacaacttcaactgtatgtttttttaaaaaagaaatgcaccaaacgcattacattttaatgatggatagaattaaatgctgtcatatgcttggcctttgcaaattgctccattaattattataggtgcttccagtgtgacatgtgagtattaaaaaaaactgtattgaatttatctgtaaatagatttgaaatgattggtgtacattctgttgaaacttcccagggagtacatattattcacattttttgtagacgtgaaagcaggaaacacttaaattgtccagaaatcagcctttgcattaaaacatctgcattattttattcctcataactgtaggaaatatctcatttaagcaatcttataagtcaactaaatgcaaataaattctccagtggagaatgacaagttcatcaacttgattccctcccactcccaacattttctgtcttattgtcaactgcttcacatggtctgttcagtggatgtgtttgtgcaccatcttcacaatgaccctagtctacattcctggttatatatcattactctaaatatcccccccaaactgtggcaaagctttgcagcacaatgaattacaatgcaatttggtatcatggaggtgaattttttaaattttgttctttgctgttttgccagagctgattgatgccagaaaggaagattgcttagaaactaggattctatgatagcctgtattgacagatgcaacttttaaaaccagtcagattgcaagccatttttacatcatattgaatcatatacttaattatgtctgtacttctttcacaccttaactttggtgaatctcaaagtatttcatgaaaacttggggaagacatcctccgtattagtcagggttctctagagggacagaactaataggatagatgtgtgtataaatgagagtttattaaggagcactaactcacatgatcacaagataaggtcccgcaataggctgtctgcaagctgcggagcaaggaagccagtccaaatcccaaaacctcaaaagtagggaagccgacagtgcagccttcagtctatggttgaaggtccaagagtagaacttgcagtacaatgtttgaaggcaggaagcatgcagcatggaagaaagatgtagggtgggagattaagcccgttcagtcttgctacactctgcctgcttttattccggctgcactggcagctgattagatggtgcccacccagattgagggtgggtctgccgttcccagtccactgactcaaatgttaatctcctttggcaacaccctcacagacatacccaggaacaatactttgcatcattcagtccagtcaagttgacacccaatattaaccattaaactctccttcctctattaaaccacataaattatatagactatctcacatctttagtgccattgcctgcctgcctgaccatgttttttatatgtgtgtacacatatacaggtatgtgtatacagaaacaggtatatgtatacattcttgtgtatattggtattatagccaaatctaatatgtgtagcttccctgtatttgatgaatcccctccttaatgtctctccctctgctcactgatcacacacatatttatttctgcacttaaaagatagatacttacatttttctgtccttctgtctttgttcctgctattccttcctcactcatctccacttgttgaaactttgtctgcccctcaagacccagggggcatattttgttctgattgtttgggtctcaattcaaaatctaccaacagataggctgtgtgatttgatgcaagtgatctaaccattctaaaccacagtgtcctttacagggcagtggggatggtaataaaatatacctcatagggcagatgtaaggctatattgaaataatctttttaaaacattatacacaactcttgccacaaaggaagggcttaaacaatgcacgctaaactctatcatctctatggagccccttttatctctatgtattaatctcttctcaagtgatctcatagtgatttgctcttagaaagctttttgtttgtttatttgtttgtttgagatggagtctctctctgtctcccaaactagagtgcagtggtgctatctcagctcactgcaacctctgcctcccatgttcaagcaattttcatgcctcagcctccagactggctgcaactacaggtccccaccaccacacctggctaatttttgtatttttagtagaggtggagtttcatcatgttggccaggctggtcttgaactcctggcctcaatgatccacccgcctcagcctcccaaagtgctgggttacagtcctgagccacagtgcccagccggaaagctcttattgaacgacgttcactagtctagtgacttgtgtgcatgtccatcttctgcattactgagcatgtatagatctacaataacaaaactgtgcgagatgctgaggatatagcagtaaaaatacaggtaaggaatccctgattacctttcaggtggagaagacacataaacaagccaacatcagtggcatattttcagatagtgataggagctataaaggagataaaagtggtgatgcgatagtctccattctgctttgtatgttaggagctacattacaaagagtagactgagaccacactattgctttagtttctctttcaaaggctccctgactccctatatgtgaggtcacaggcaccctatataaagctgccagagctatgcttcatagcttctctggcagctgcttcctccctttcattcaaatttatttgctctcatcagatttaaacgcattttctccttgtatctgatcaccccaccgtgtcttccattttactcagattaaggccacagtctgactggtgttgatttcaggttcatgccaagacactgtaagtaactctcattcctccttatgattccatttactactgcctaagagcacaagcgcagagccagggcatctgtccccatgtcctgccccccagtgtgtgttcttccttaaataaccaggtagggaagggcagataaggaagcccctacaggcaagtcctaatggtcttccaaagggaaaggaacttggtcatagatgctctcaataatagtaccaactcccatcgccgagttttattttagagtctcagaatgggtctagtgacacttgctctcataataaagtagaagaaacatttcttttggataaattgcccataggcttcattatcagaagctccatacatctaggtttctaacacttttaccatctttcaccatgagctcctttcagaaactctcttgagtctcagagccaagaatgaatgctgagggaaaagggagatgatatctatcttgccatgctttaccctgtatctctctgcctgtctatccatcactcaattcagatgtatactttatccttccttttttctgcaaaatacctctatctaaacctgagagcacaagactatagaagaactggatttcctaagtgagtccatggattagactcaccatgccctatagggtctgtctatagaggagtcacagaaactaggacatttgggctctctgaccaagaatcactgaaaatgggcgcaggctttttgtggctaaccctgagcatactagattaatatatctgtttgaagtgtatgttagggttgcatctagagataaacgcagtgactctaactgatgtcaagaaaagcaactaaccccttgtcttgtattctgcaaacatctagtattattctgcttgttcccaagacacaggcttcatgaattaatgcctcctttcccagttaaatattcaaaactcatttgcctaaactaagtggcaaagaaaaaaaatttaaagatgggtgtggaggagcattgcttgattgtaccaaaagcatttgattaaattgattggagagctacagccaaattaacgaagactggcacaccttacctatctctttctcttatttttcagacatgaaaattgctcaggcttcaagtctagtctgtgtgaaagcattaagtgtttcagaaatcaacatgtcttatcaatctattgtgctctggggaaaaaaaaagccagttagtgacattatttccttatgttctagaaacctgataataccttattgtacatcaggagtataagcaaatttcattgtaaagaggttcttctgacaagatctgtgaagaacatgatgttattaacttagacgtctgcacttacaatatagcttttccaagacaatttttgctgggctacaggtggttatttaagacaatcaatttacatagaacaatttattcttttttcatgctgttaaagcaaattggtatgtaattagatttatatactgaataatctcatttgcatatccaattaattcttcctgttttaatttgctagggttgaattcacattagtagtaaaaataacacttaaattataaaggcctcaaaattttctttgctgtaatttgttcaagatgttgcatttaaaaattggtccccagcattctttacaaaatctactgggaatatgtgaaagattttacttaaaagtgcccttagccaaatatcacacttgaggttcactctttgttcatgatgaagaggttaatggatggtagaaagctagtccttgcctcaatacccaataatattcaaaacaaggaaaactcaggttctgttttcaccctctgacctttcatgctttgagtatgtttaaacactgagacatacatgcacagaaatgaaatctgttcccaaataatttatatttattcttcaactgtatcacttcaactattgttgtttaacacagtgggaatatatatactgtagacaaatattattctttttggattcagatacaccagagcttagtatttgtttgtttcttttgccacttctgatattgggaaaccgattttgtctatctaagagtcagtgtcctcatccttaaaaccaaaagagaaaaatatgtgcctttctagaatgactaatttcacatggcataacatataaaagtatctactagtgtggatccaacaatagaagatgttcagtcagacatggtatctggtctgtaataaacatatataaacactatcaatcaaaatgaatattcaatttctaggacttcatagtatttttattaagttcagtgaatgtttgttagtggccattttcattaccagactttagattcaaatattggctaagcattttgtgcaaattatttagtctctctatgccttagtttcttcgtgtgtaattcgggaataataaaaagtatttttacctcgtataatcgtggtcagaattgaaggggttaatacataccctcagactattccctggtgcatagtaagcactcaatgaatgttaaccatggctatcattgttaccatgttgaaagaataggcacccatatcagagtttctttattgttatctattagtaagtgtaagagtgttttaggactaccttaacaaagtaccactgactgtgtagcttaaacaacaggaattaattttttcatagttctaaaagctagaagtccaagatcaaggcttcagaagtttagattgttcctgaggactctctccctggttttcagatgatcaccttctccctgtatcctcacatggcctttcctctgactgtatccaaatttcctcttcttataaggacagcagtcagattgggttaaagaccaccctaaggtttcatttaacttaattacctcttaaaaggccctgtgtccaaatacagtcacattctaaggtaccaggggttagggcttcagcatgaaatttggggaaacataatttagctcataatgccaaggttgaatttcccttatatctggtagagaccctgaagctctgttttcagaactgatattaaatgtaagcatatctgtgtacttaaggtatttaaaaagcaaggccaggcacggtggctcacacctgtaaccccagcactttgggaagccagggtgggcggatcacccgaggtcaggagttcgagatcagcctggccaacatggtgagaccccgtccctactaaaaatacaaaaattagccaggcatggttgtggacgcctgtaatcccagctactcaggaggctgaggcaagagaatcgcttgaacctgggaggcagaggttgcagtgagccgagattacaccattgcactccagcctgggcaacgagagcgaaactcatctcataaataaataaataaataaataaataaataaataaatagcataagtaacctatgccttatctcaaggtcttggcccattttctgcagctacagccatgctttcaaagctatacttttattttctcccctcagatttttatagcctgtgcatcagattcatgtaatagaaatgtcataacatttatattaggtctctattccagagacctaggcttacacctcatatttgttgtttgttgtataaatatacacatacaaattacctaaactcaggcaagtgattttacctccatgagacctccttttacttatctgtaaaaggggacatatttcctcacaaacagatgcaaactaagacaggatagggaaaagaattttgtaaattctaaattgctgtagagataccagctgtctctgcttactgaaaaggcaatcttaattccattttctattttatggtcattgttagtttacagttactaatattaaatggctttagtggtcactttaggagagacatttactttgttgttaaaccaatatgtttacaattagatataagtttctttctggatttgaagataactgtaatttgcagttgacgcttatgcaaattgctatgttctgctgcatacccattttaaaatacaaatccttcccagtcatcactgagtgtatataacaactgcaaagaaaacgctctgaagatttttttttcctgtcaaaatgccactttgccttcagaaccaccatctaaacattatcttaatgacacttactttatttggaatgccagtatcctttgtgtaattttcagatagcctgcagatatttgaaaaactttaccagcttcttcatcatttcagtctgggaaatgagcatcctattactggcatgccttgtgttattgtgctttgctttattgcacttcacagattttgagttttttttgcaaactgaaggtttgtgccaacactgcatcgagcaagtctactgccaccattttcccaacagcatgtgcttactttgtatctcagtgtcacatttttgtaattgtcacaatagttcaaagtttattcttactattatatctgttatagtgatctgtgatcattgatgtgaccattgtaactgttttgggataccatgaaccgcacccatataagacgaagaacttaatcgatcaatgttgtactctggctgccccactggctggcctctcccccatctctctcccttctcctggggcctcccttttccctaagaaacaacaatattgaaattaggccaattactaaccccaccgtggcccctaagtgttcaaatgagaggaagaagcgtacatctttcactttgaataaaaaactagaaggaattgaccttaatgaggaaggcatggtgaaagccaagacaggctgaaagctatgcctcttgcgccaaatggttggctaagttatgaatgcaaaggaaaaattcttgaaggaaattaaaagtgcaacttcaggcaacgcatgaataagaaattaatacagtcttattgctgatatggcaaagtttgagtagtctggatagaagatcacaccagccgcaacattcaacattctcttaagcgaaagcctaatccaaagcaaggccctaattctcttcaattctgtgaaggctgaaagaggcctggaagctgcagaaaagaaggtggaagctagcagaggttgcttcatgagatttaaggaaagagatgccacctccttaacataaaagtgcaaggtgtagaaacaaatgctgatatagaaactgcagcaagttttccagatctagctaagataattaataaaggtggctaccctaaaaaacagattttaaatgtagataaacagccttatgttggaagaagatgccatccaggactttgataagtagagaggacaagtcaatgcctggcttcaaaacttcaaaggacgggcttactttcttgttaggggttaatacagctggtgactttaagttgaagacagtgttcattgaccatcctgaaagtcttaggacccttatgaatcatgccagatctactctgcctgtgttcttttatggaacaacaaagcctggataacagtacatctgtttacaacatggtttgctgaatattttctgcccactgttgagacctactgctcagaaaaaaagattcctttcaaaatattacttgtgtttgacaatgcaccttgtcacctaagagctctgatggagatatattaggagatgtatattgttacccttccagctaacacaacatcgaatctgcagccaatggatcaggagtcattttgactttcaagtcttatttaagaaatgcattttataaggttatagctgccatacatagtgacttctctgatggatctcggcaaagtaaattgaaactcttctagaaaggattcaccatcccagatgccattaagaaaatttgtggctgggcacggtggctcatacctgtaatactagcactttgagaggctgaggcaggcggatcacttgaggcaaggaatttgagaccagcctgaccaacatggtgaaaccctgtctactaaaaatacaaatatatctatctatagatagatattttacatataaatatatatatttataaatatatataatataaattcatattatatgtataaaatatgtatttttataaatatatatatatatataaaagggaagggaaaaggaaggaaggaaatttataattcatgaaaagaggtcaaaatatcaaccttaccaggattttggaaattgattccaaccctcacggatgactttgaggggcttaaagctttcaatggaggaagcaactgcagatgtggtggaaatagcaagagaacaagagttagaagtggagcccagagagagaagtgattgaatcgctgccatcatgataaaacttgaatggatgaggagttgcttcttatagataagcaaataacatggtttcttgagatggaatctattcttggtaaagattgtgcaaattgttgaaatgacaacaaaagagaatattatgtaaacttagtggataaagcagtggtggagtttgagaggattggcttcagtttgaaaagaattcctactgcggataaaatcccagcattacctgctgaggaagtctgtcatgaacggaagactcaatcaatgcagcaaacttcaatgttgtcttattttaagaaatggccacagccaccccagccttcagcaacatccaccctgatcagtcagcagccatcttaatcgagggaagactctcccccttcaaaaagataacaacttgctgaaggctcagataatcattagcatttttaacaataaattattttaagttatgtacattgtgttttttagacataatgctattgtacacttattaaactgcagtatagtgtaaacatgactcttgtatgcaatggaaaaccaaaaaacttgcgtggctcattttattgcagtatttgttttattgcactggtctggaactgagcttaagatatatctgtatagataagactatgaatgtatgaaatttcataggctggaggtatcttaaagaacatctaattcatttacaatcctgttataaaggttatagactctttactatggaacgcaaggatattaacatcttttactagcagacattgagtgaacaagtttatatgtcaaaaagactgttacggtcttttcctttctgatgccttctaagacatggtggacctaccagggtaaagattcaagagtggccattgcagtctatttaacagctccattctttcaccacctcctttgatctcatctttttgagcctctttccttgcagtgaagggacaagcagggtagaaaaaaatattcccttaggatcctcttgcttcctttgtgctcccgatgatccctttgtattttcaatctgtgggtctctttaatgcctttattctctccttctcccaaaaatagtgtcagttcaccaaggacaccacataggtagtcagtcatttggttcgatcagattctcatggaacctacaagacaagcacccttttcacttttctaggaatggcctcctcttagcatataatctgggtgttacactgaaaaaagtctagctcttcctttgattgagtagcattatcaaaattaccaagggccaggcacggtggctcatacctgtactcccagcactttgggagactgagccaggaagatcgcttgagcccaggagtttgaaaccagcctaggcaacgtagggagacctccatctctacaattttttttcttttttttcttttttttttttgagacggagtctcactctgttgcccaggctagagggcagtggtgctatcttggctcactgcaacctccacctccctggttcaagcaattttccctacttcttactctcgagtagctgggattacaggcacctgccaccactcctggctaacttttgcattttttttagtaaagatggggtttcaccatgttggccaggctgatctcaaactcctgacctcaggtgatccacccgccttggccttccaaagtgctgggattataggtgtgacccaccgcacctggccaaaaaaaaggtgttgtttttttttttttaaatagccaggtatggcggttcatgcatccagttctagcaacttggtaggaggattgcttgagctcctaccaacatttttcgattgctgaggcaggaggattgcttgagctcacaaggtcaaggttgtagtgaactatgattacaccactgcactgcagcctgggcaacagagcaagaccctgtctctgaaacagacaaacacaataacacaccaagaaatttgggaacagaagggaaataaaaacctcatcccaattacacattcacttacaaaacagatacttagaaagtgcctaaataagtactagtaatttatgtagtaccagtggaaagtggtctaatagtcttattatttcaactactatccttatggatctgctaatctaaacagacacctctctcccaaaatacagtaagtgttcagcagataatgaaaggggactgctgtgcagctgctgtggggcatggcattgaaactgaatccaaagcccactgggtctgtgaggtagatggaatgtgacagggagagaagagagaaaagacttcctagagaaggtgccaatgtttctaggcacacaggaataacaaagaaaactcagcaggggcccagagcacagggacttgtccaatgagatgagagaagcaaggaagtagtagtacaggtctcagtggaatccttgccttagtatggtatgtgattttttatagtgcagagtggatctcgtgtgtgaatgtattctccatcgtagacgtgtggtcgcttatcagtgtggtcacttatcaatcacatttaagctgttgtttaaaatacttatggatcttttcttttggaattttctttacggctcctattttattcctctgaatatttcaagtgcttgtaaatccttgtcctttgaagttagatttcatttttggcaacagctaagctttccatatttagaaacttgttcagagccatttcatggtaaatgttggtgttcatgctgggtaatactgttttttggtcaaaaatgaattgtgactataaattaatgaagctaatttttttgtgtggcttataaatcagttctctatcatttttaaagggggaattttaaaacatacgcgttaatacatgtgaaagcttttttaaaaattgtaaatctccacaatttttaaaaattgtaaaaaaagcaaggactttttttatttttattaatcattaagttatattacatttcaacatactgctttaaaactcaataaataagttttaaattctcttttaaactactagtttcttaagtaattgttcatttgatgttgtctaccagttgagcaactggtacattaaccagagctgtagattgagctcttttccaaatatttagattttgggttcatagagaaataccttaagagaattgtcaaatgaggaaactgacattcagaaaggagaaataagtaaggtatctaagatcacaagggtagtaattgacttaccaaataatatagtttcaaatccctgacattaagtcaactaaagattggtcttttcactgatgtagatctagtcattttagtcagaaatactcttctttctcctattttctctctaaaacctctgccttcaacctttgttagtctccccatctctttttgtattgcttctatctgtgtgagggtttggataacaagaagatagtcttctttcctttatatttcctttatttttcttcagtgactactcaaaaatcttacccagaatggacactaaatgaatgaatttctaattgttttgcagctttctcttctgttaggatcaagtgaccagttcgtctctaccaaacccaggatgtgtttttgatttatgtgatttgtggttttgagttataagtggttccataaggccaactagcagctagaaaacagtaagtttgggactgtaaacagttacagggaagtggaagtttttggttgttttattgttgttaattctttgttttgttgcccttggtagacaaaacttaagtgatgatagagcttacagttgctaatttacccaattccatgctttgctttttgaaagcaattgctgtgtttcccttcaggggatgagctttatttactccttctactccaaagctgagctataggaattcaagtggggtctggaaataccattgaaaaaaagagtttttttgaccaccttggcaatggccagttgtttctttccatggccagcctctttgttgtttgttgagaatactgtctaagaaaatcccctcaaaattagaagtctctgaaaactatacagatctcaagggcctaaaagggaatgttatcattttaattattgtgctactttcaaaattatactgtttgtaatcatgggtattgaaaaagcccagacatttgagtttaattatgtgctttgtaatcctaagatacaatccttttttctcatgcttttatataccgtgtttctctcttttctccaacacttaataaggccaacccaagggtattaattccgggaatgagtaaaaatggtgttattctttctcaaagcctagtcaggtcagtccacaagcattcagccctgctcacagtatgtatttgaagaatgtatctttgtttagaaaagaaaaggaaggtttgggaagagtgtggattaatattatatgctgcttccctttgggcctgttttttccccccagtcctttcttaccctagcaaatacagttaggagtcctggattgcacattgtaagaacaaataggaatctgcaggccttcctggaaggtctgggtcatagcagcttctttgcttcttcttcttatcttctgcgtggcactagctagtatgccccagataacacagggaaggaatttgactccttgacatcttacatgcagccaaacacttcagaatgtatagaactttctgaatccaggtagcatctcactctgaatgtcagatggatttttaaaaaatttattccccaaataattgtttatgaggaaattttttgtctctctaaggtgcagccacgtagagtcacttattctctgaagggtcccaccctataagtgatataaatcctgatatttcaaggaatttagaaaatatgtttgttttattcctcctccctccagtgtgatacagaatcttaataaggagcctatgttgccttttgaatcattaactctgaagaaagttcaggaatgttagacttgggagattaataactgtaactgcaaagagaagtcttgtctgttaaagaatttgtgtgcactattgcatcactcagtatgtatgtgaggctttctatttttaacatttttaatgacaagctgcctccttggttctgtatgcccttcacctttgtcagaatgagattgatagtgaaagtttctctgctgttctcataaaagttgaattaagggtcttgatttcggtttactgtactgcagcattatctctcattcatctagtggtctcttctctgtttctgtttcctgctctgcctgtattctagcatgcagggcagttggcagggactggccatgcaaaataatagctgtttccagaataagtcattgagtcatctgaaagtacaacattatagtgacatacctgacttctctataatgcagaaaagggagtcataataacttaaagcattgcacattgccagagctatttgaaatgacggaacatgaatattttgacatctagtagtagcctagtgcctctttgccagaagatgctaatgaaacaaacatggaaatcactgcgggattaccaagactgttttgactttctttcaggataatcccactgggtttttaacttgcaaatatctgaatgcccatcacatggaggaggaagctgatttgtttgcaatagaacttgaaaaaatggtgaaaactaaagatactttctaccttggatttcggatttgctttctgataattagagatatctcaaaaataaaatggactttctggaatggaaaagataagaatgttttattgtcctcgaggcattagaattgtaaccgtatttggcgagaatgttgaagagtagcaccatgcatcctagggaatttttaaaacaattaaaagagaataattataagtcaaagttatcaggaaggaaggacagatgtaatctcatttcgctgcatgatagtaaatgaaggtacatataatatttccaagagagaaaaatttactcaaagtccaagaaattcagagtaaattcaaatggataagaaggtaaaaatgtagtctaaggattataactacttctgcccatgcaaaaagcagttatgtttataatcccagattaaattgcccagaagtatcatcagatcccctatctggttctctttagagcatgtttcaccaactgtaatcaaagatttgtttttatgactgattgatgtctgttttctcccagtacattgtaaattccatgaagacagcaactatgtctgttctctgtttgaatcccaagctctagtacagtccctggagcataatgcggactaacttaacatttggtgagtgaattaatgaatgaatacattgtgacaattataatgtgacaataaattattgagaggtcaagtctcaaaagggaggtctaagctaattaattttctgaatgtgtatgcagtactagcttatgtacaaaaatctttcttcagatgtgtatgagtcagcagcaactggaacttggaggtggtctttagaccccaatgtcggtatctgttcaagtattctattcgtaccttatcagctgtcttccttttcctgtggtggaaggactgccagtttcatctaagtggtttgcctcagagttcaggagaatagctcattgggagttctggtcagatattttcaaactcaaatgagtaagctctctgaaaaacctatacataatgaaaaatagtttaagattacagtggtgttttgatgtgatctggaacagttcacccactcctacttggcaataaaaataaattatgcaatgggacagccaactgttacagcttggaaaactgttaaaaactcaaaataaatacgtaggttaatgtcatgaagtacttgaccggacaagcatatttttccaattctaagggtagaaagtgtctttgtaaacattcctacatgtcagaaaactaaataaaaatgacctctagcttcgaggcacttattggaaacctattttacattgaatacacaagccaagataatacagactgtttgataagaaacattagagaaatctgtaacatgaggctttttattataggtttattacatcaatctctccagtgggtaatggaacttgtaaatatactcttatgtaggagtctccttgtgggctttttattcatgctgaagtaagcacagcaaacttatttgctgtcagggtacattgaatttaagattagtatttattttggttctaaggaggttttgcgtttgtgaattgaaagttggatcagctgcatgaaaacaagatgggactacagggagcacaggaagtaaattagttttttctaaatatgcattctgtaaacctacgtatttagctagcatggggtgcgtatgcgcagtttctcagatgggtgagtcatgcatcggatgtgtatgtttatggctctgtggtttgggtagagatagatattcaaaatggcatattgcagttactgttttctaatgcaaatcgttctagagaaaaaatatatatgtttataagaaagatttcttaacctctttttgaccagtgactttcttaatttcagtgggggcatatgaaataaaaccctcaaaatcatcagccacactgtaccttccatatcattgacagataacactgacaaattattccggcttgttctgacacctgaatagaatgtatcaggtggtaactgaagccatgaggatgagttgcccatacagaggaaaggattataatagtaaatagctatgttttatgaatgacatactagatactgtgcgaagtgaactagatgtgttatttcatttaatgctgtgcttatgagacagccaggtcggagggggtacctggcaaaactccagccagcctgtgccctggggtggacccacaggaagttcgcaccttttgcagcggggaggagcctggctgctcctcttcctgtgtggaacctgggattcggcagggtgggaagtgctctgtcagggactctggcccagcaagagtccctgttttccttttttcttcctttcacccaataaaaccctgtcttactcacacttcaaaccgtctgtgagcctaaattttcatggccatgggacagacaaggaccccatcattagctgagctaaggaaaagtcctgcaatacttacatcacatgactatgaaggcaggtaccatggacactctcatttgtcaaagacggaaaagtaaagcacacagaggtaatacgatttactgaaattcacacaaataaatttaaagtctgttccatctatgttgtgttgttaccttaggatctcacttcatatttgtgaagaatcatccttcccatttccttaaatacccaaaccatgagcatttgtaccatcctttattccttttggacatttgcagcagaatgtctattttgtttaatattagctcataatctgggaagtgagtagtagtattcacattttatctgaagtaagtgagacttagagaggtggagtgacttgcccaggcctgatttactgggtcttagtttcaagcctttttttataatgaagctcactctatctccaatagagcatgttcaaggttctaggtccagaaagggataagctgcaaatcatgaatccataagaataaatacctacttgcatttttttatgtggacatgcaaataacacacccacacacacaaacagacacacacacacacacacacacacacacacacacacacacacacagaactaacctaatatttcaggtctcatgaattgtatttggtttaaaaatacagtgagatcagaaagaatgctctgttcaaaaaaatcacatactttgtctcattagagacagaattgatactctttattgaagagtaaaattcagtaagaaccttcttaaaaataggagcaggccaggtggtggctcagacctgtaatcccagcaatcttaggaggccaaggcgagcagatcacttgaggtcagagttggagaccagcctggccaacatggtaaaaccccgtctctactaaaaatacaaaaattagccaggtgtaatggtacatgtctgtattcccagctactcgggaggctgaggcaggagaatcacttgaacccaggaggtggaggttgcggtgagccgagatcacatcactgcacttcaccctgggtgacagaggagactccatctcaaaaaaaaaaaaaaaaaaaaaagaagaagaagaagaagaaaaagaaggaagagagggcaaatgtgtattatcttataggtattaccctagtctgcagtgaggtttttgttctcttatgtcctataaagatcagtgaattctaacgacttttacactaatgttcaagttggtccttaattttattatttcccttttcacttatttgacttggctttctacataccagatggtcacctgagcccagagccacatcttttcatttgttatgctttacaatttgtcataatatctggtatatttgatatggacaaatatttgtttgattgttttcttttgatgtggtgatgtttgaactcatcctaaatgtacacaatagttttgagagacattttaaacccaataacatgtaaatttcttaaaacattgctcctgttcagatacatcgaactggaaacctggtcagggattgtgtgaacagcttcattttctcactataccttgtacatgaaatcctatttctgtttgtcttttattggcttttaaaatagcatgacgatctgatgcacagtcactgggctttggcaaatctctatttcctcccagccacagaaatttacatttcttcccaagctactctgactgtgaataatctatgtgaggagtgacctcagttcatttgaaagcatccaacatcctgaaaactgtaaagccacagcacgcactgatttctcaaggtctaagagatggtttataaatgattaaaaaaaaaactctaatagtatactcaaaacattttttaaaaaaagaaatagagttatgagtctgcaaggacttatttaagaaagacgtcctaatattgggggaggtggattcactggcactgttatatcaaccaagtatttcatgtgtgaggagataaagcagcaaactacgcaaaataaacagcgtgtgttcaccttagatatctaggacgcttcactttgaataaattttctctgcttttttgaatccagagcaatattgtctgttagacaagttctgggttttgtctgcttcaggcctgtcttaaccctgccattaattggcatatgtccaggcaattaaaactgtggtatggagcaaattaaaaaagagaatttaaagcaccagagtcatttgaaattccaaggtcaaatggaaataacattgaattatcttcttttggggattatacctgcctctatttgtctccaccagaggtgataatctagactttggttacctactctttgcatcctcaaaacgggaacacacaggaatgcttttttccgaaggccagaatgacagatataagattgaagttaaacacaactgatgcccagcacgtcagagcaggacaaagaatcagaggcaatttaatcccacctttatgcttttgaaagacaaaaggaactcaagcccagaatggcaaaatgatttactaaaggtcatcacaactaggcacccctctaattctggtaataattaaaatcaacaatatttattgaacactgacctttgccaagcactgtttcaagctcttcccatgattttttggtattatagttaaggagcggaggtaaagggacagtgaaataagtatcctctatatcctactactaccaaacagtttttcttcagctgagccaatagctaccatcttccaactaattcttagccagactaagatgacaaaggaaatacactaagcatgatttagctttttcttatgtctccagttgttgttttgaaagtgtattcatggcagggaaatatcccaaagccaggcagccccaaggaggagtgcctctagcatgagtattccagaaagtcatcaacctctgaatacttaagttgaccctgtgatttatgtatctaggactgaaataaaacatttctgactttctatacaagattttgcaatgtttatattagtcaagatcagctttttccaaaacatgctcgatggatcactcccttctcaggatgctgtataagaaagaagcaaaaaagctgtgatcaaataatttttgtttaaaaaaaaaaaatcctggccaggcgtggtggctcgtgcctgtaatcccagcactttggaaggccgaggtgggcggatcacctgagatcgggaattcaagaccagcctgaccaacatggagaaaccctgtctctactgaaagtacaaaattaaccaggcgtagtggcgggtgcttgtaatcccagctgctcaggaggctgaggcaggagaatcgcttcaacccaggaggcagaggttgcggtgaaccgagacgccattgcactgcagcctgggcaacaagagcaaaattccatctcaaaaaaaaaaaaaaaaaaaaaaaatcctgcatcatcctgatgatgttcattatcatatagaaattttaagaatacccgtaataaatgttttttaagtcagcatttcccaaattcagacaaacacagaacccaaccccctgccaccttttgttaaaaaattcatgttaaccttcctgcagagcagatatcaagaaagatgtgtgagaggaaatttcattcaaaaaacacttatcaagtgctgatattatagctgatgctgggttatagagatcaaagacccagttccagaattcatagagctcacaagctacagaaagagataagcttgtaaatcacagttataatacagtttagtaattagtgtcatgcacaaaaataggggatgtggagctagaaattaagatatttcccatcaccttgctgttgaagagtagtactgactgctatattatattatccctaaattcagaggcttaatttactagaaatttagatctcactcatataagattcaatggaggagagtggcagcaacaactatggttcatacagtcattcagggatgcagattaatcttcagtgtgtgactttccagatgtctttggacatcaacatccagctgctaaacaggaaaagagaaaagttaaaaggaacactgtgcaagatgcttttatgatctaggcctgagaggatacatttctttcacctgtggtccaatggttcattcatataactacaactaactgcgagagaggctaggaaatgtgggctacttctgggtcctgcaaggatggggaaagggtttggtaagcagctaactagtctcaacctcaatgggcaatatgaacttaggcaacagaaggtatagggaccttccaggcagaagtaatcaactatctgttgacataaaggaagggcaatcatggcactattgacaccctacgaaaagtatgatatggcaagagtagagaccacctgcggaagagtgtaggagacaggatggctgggaacagtggctcatgcctgtaatcccagcgctttgggaggctgaggtgggtggatcacttgagatcaggagttcgagaccagcctggccaacatggtgaagccccatcttcacatttgtattttagtatacaaaaattagctgggtgtgatggtgtgtgcctgtaatcccagctgctcaggaggctgaggcaggagaatcgcttgaacccaagaggcagaagttgcagtgagccgagatcacgccactgcactccatcctgggcaacagagtgagactctgtctcagaagaaaaaaaaaagaaaagggaaataaagacacaagatcatgtgagctttttgtactatgttaaggagcttgtattttactttttcaatgatggcgatttattaaagaatctaaaaatcattgaactagaatcaaaaaagtgagttaagagattaatggtatataataggaatagataatgagctaacaagtaattgatggcatagaatagggatggattcaagaagtactgtaggtaaaatatacatgacttggggacccagtgaatgtaaaaagtgaggaagagagaaggtacagtcaagaatatttcctgggcatgtctggctagttagatattgttctgatttattaaaaacaagagacattgggaaaggaatttggtaagtgggaggaactcataagggtctgaagtataggaaggaggttgaaacttgagggtggtcagcatgtaggtttccttgaagcatgtggaatgaatgcagtctaaaggagaaagaaaatcgaggcatgcagagagcttagaacaaaaccacacaccagaatttaaagggctcaaagaagaatttgtccatgaagaatctaaaatgataaagagaaccaagggaagaaagaattttttaaaacaaggtaggaaacaacccacatgtccatcagctggtgaatgcatgcatacaatgtgatatgtctgtaaaacaatactattcagcaataatagggaataaagtactgatgcatacatattacaacaaagatgaaccttgaaaacatactaagtaaaagagtcctgtccaaaaagaccacatattgtctgattctatttgtatgaaatgttcagaatatgcaaatctattgagatagaaagactagttgttttctggggcattgagaggtaggtgggggtggttgggtagtggggaaaagggaacaaatgctaatgagcacaggttttttgcaggaattaggaaaatattgtaaatttgattgtgatgatggctatacaactttgtgaatgtacttaaaactattgaattatagactttttaaataggtaaattgcatggtgtatgaactatatctcaaagctatcagttaagaaaaccaaaaaaggaaagtagaaccagtgaagtttggggtaatagaaatacatacgtcttctaagccagcttctggaggcaaaattcaatggcttctaaaccaatcctgtgattttcttttttggtccagaattgcatttgcatttttctgtgggaaacacttctactttatttgcagatggtcacattcttaaggcatttagatcatcacctatattttttttccttaagtaagtctagattttctgtaaattagcattgaattttatgataagtaagttggagaagttttatatagtaaatttctttcaatatcaaaattatcttgaagataatacacttagctataaacatgtaacctcccattatccagggttatatagtcaatatctagactttcagccatgcctgggacccaaagtgagcccagccacatcttatcagaggaaagcatttgtcattttacatttaaattcacatctgaggtattctccaggttttcttggaactgcagaaatatcaccgttatacattatttagtaaccagcttgctttgcaaaggtcaggttcgtgttattcaaagcgtgatgcttagtatgcgatgacacaaacagatttcttgctttaaagtaatagaatgcgatgagtgaaaccaactttctttggaagaaagatgtctcctttccacgacatttgatttgtaagtgggtttggcttcattaatatttaattgtctttttaatctgtatgtcagttcttattgcagactgcttctggggaggttttcctctgaaataccaataacaaccattcttcactctaacatcaaaacaagggctctctccgggacacctagttgtatttcatctctagggatataattattttgtcgttatccacagttcctcaagggactgatgatgtaggacaccctccttaaagacctttatatgtcaaaagaagaacctgatttgttaatgttgcaaatactaattcagatggtcttgcatcattcttgtgagttgccttttcttaaccaggctatacagaatttgtacttttttattagcacgttagtggagtttgaagctgttagttgatcttttcaggatattttcatgagctttactagtttaggaaacagtgctttttctgtgggatgcattttgaacatttaaattcattttcaaacacaaatcagaatagggaatgaaatgataaacaaccctttataaattttcaacttgatcacctatagcaataaagctacaaaaagaactcagaattagtatctctggagattgacatagagaaattgagattgacatctctgcagcaagttgagcctctttgtgaactggtcatttttatttcctggtcacttgggagaaacctgggtgaaaaaattggacatctgtttttgtttgtgatagcaaattccctatgggatgagcctcaccctaattaggggaccactcttggccctctcaggagagaatataagggtagataaggagacttaggttaccctctcaatcaatcacagtggggcaaaatggaataatttcacacattttcctttagctggatacttgatatatgagaaaaaatatggggtatccacatcctaaaattttaacacttccctgtgcttaccaacgtggcgtgtggtatcagtggaacggatgctttcatctgccttttttcgaaggttagttgtggcattgccttgattagtcaaagattttatctcttggtaaaggatattatcgatttagatagacacattttgaagttagaatacagcttgtaattatgaatgggcgaagatatctgacccttaaaaaattcagactccctaagttgtctacgcagcatgcaggttcacctgcactggtatcacacccaagctagcaatagaacaaattcatttgactttattttatgacttttcctagaagagacataacaatgaatcatcttgttatccaagccaataaatatgcttccttttagatttcttaattcagtttgccagctattttgggtattagaataacgggtttcatgtccttggggggtttaatttgcttccagagtcttgtttttgtagaatagcttaagtcttcatagtcatggtttatgattcttcaaataggtcattataagtaagatctgattttgaactggtattaagaaaatagacattgaaaaaaactgtttcagggaaaaaacattttcctttctagatcatagtgcaataagtggctcttttatgatcactgttgatttttccaaagtaagacattactgatttattttatctatgttagctttttcttccaaaacaattccttgatgtaattttatcataaggaataaaatgttctttttttatttttattttttattatactttaagttctagggtacatgtgcacaacgtgcaggttttttacatatgtatacatgtgccatgttggtgtgctgcacccattaattcctcctttacattaggtatatctcctaatgctatccctcccccctccccccaccccacaacaggccccagtgtgtgatgttccctttcctgtgtccatgtgttattgttcaattcccacctatgagtgcgaacacacggtgtttggttttttgtctttgtgatagtgtgctgagaatgatggtttccagcttcatccatgtccctacaaaggacatgaactcatcctttttcatggctgcgtagtattccatggtgtatatgtgccacattttcttaatccactctatcattgatggacatttgggttggttccaagtctttgctattgtgaatcatgtctcaataaacatatgtgtgcatgtgtctttatagcagcatggtttataatccttggggtatatacctagtaatgggatggctgggtcaaatggtatttctagttctagatccctgaggaatcgccacactaacttccacaatggttgaactagtttacagtcccactaacagtgtaaaagtgttcctatttctccacatcctctccagcacctgctgtttcctgactttttaatgattgccattctaactggtgtgagatggtatctcattgtggttttgatttgcatttctctgatggccagtgataatgagcattttttcatgtgtcttttggctgcataaatgtcttcttttgagaactgtctgttcatatcctttgcccacttgttaatggggttgtttgactttttcttgcaaatttgtttgagttccttgtagattctggatattagccctttgtcagatgagtagattacaaaaattttctcccattctgtaggttccctattcactgtgatggtagtttcttttgctgtgcagaagctctttagtttaattagatcccatttgtcaattttggcttttgttgccattgcttttggtgttttagacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctggccatttttcctagcaccatttattaaacagggaatcctttgcccatttcttgtttttatcaggtttgtcaaagatcagatagttatagatatgtggcattatttctgagggctctgttctgttccattggtctatatgtctgttttggtaccagtaccatgctgttttggttactgtagccttgtagtatagtttgaagtcaggtaacatgatgcctccagctttgttcttttgactcaggattgtcttggcgatgcgggctcttttttggttccatatgaactttaaagtagttttttccaattctgtgaagaaagtcattggtagcttgatggggatggcatggaatctataaattaccttgggcagtatgaccattttcacaatattgattcttcctaccctggagcatggaatgttcttccatttgtttgtgtcctcttttatttccttgagcagtggtttgtagttctcctggaagaggtccttcacatcctttgtaagttggattcctagctattttattctctttgaagcaattgtgaatgggagttcactcatgatttggctctctgtttgtctgttattggtatataagaatgcttgtgatttttgcacattgattttgtatcctgagactttactgaagttgcttatcaacttaaggagattttgggctgagacaatggggttttctagatatacaatcaggtcatctgcaaacagggacaatttgacttcctcttttcctaattgaataccctttatttccttctcctgcctgattgccttggccagaacttccaacactatgttgaataggagtggtgagagagggcatccctgtcttgtgccagttttcaaagggaatgcttccagtttttgcccattcagtatgatattggctgtgggtttgtcatagatagttcttattattttgagatacatcccatcaatacctaatttattgagagtttttagcatgaagggctgttgaattttgtcacaggccttttctgcatctgttgagataaacgtggtttttgtcgttggttctgtttatatgctggattacgtttattgatttgcatatgttgaaccagccttgcatcatagggatgaagcccacttgatcatggtggataagctttttgatgtgctgctggattcggtttgccagtattttattgaggatttttgcatcgatgttcatcaggtatattggtctaaaattctctttttttgttgtgtctctgccaggctttggtatcaggatgatgctggcctcataaaacgagttagggaggattccctctttttctattgattggaatagtttcagaaggaatggtaccagctcctccttgtacctctggtagaattcggctgtgaatccatctggtcctggactttctttggttggtaagctattaattattgcctcaatttcagagcctgttattggtctattcagagattcaacttcttcctggtttagtcttgggagggtgtatgtgtcgaggaatttatccatttcttctagattttctagtgcatttgcatagaggtgtttatagtattctctgatggtagtttgtatttctgtgggatcagtggtgatatcccctttgtcattttttattgcatctatttgattcttctctcttttcttctttattagtcttgctagcagtctatcaattttgttgatcttttcaaaaaaccacctcctggattcattgatttttttgaacggttttttgtgtctctatctccttcagttctgctctgatcttagttatttcttgccttctgctaggttttgaatgtgtttgctcttgcttctccagttcttttaattgtgatgttagggtgtcaattttggatctttcctgctttctcttgtgggcatttagtgctataaatttccctctacacactcctttaaatgtgtcccagagattctggtatgttgtgtctttgttctccttggtttccaagaacatctttatttctgccttcatttcgttatgtacccagtagtcattcaggagcaggttgttcagtttccatgtagttgagcagttttgagtgagtttctcaatcctgagttctagtttgattgcactgtggtctgacagacaatttgttataatttctgttcttttacatttgctgaggagtgctttacttccacctatgtggtcaattttggaataagtgtgatgtggtgctgagaagaatgtatattctgttgatttgcggggagagttctgtagatgtctattaggtctgcttggtgcagagctgagttcaattcctggatatccttgttaactttctgtctcattgatctgtctaatgttgacagtggggtgttgaaatctcccattattattgtgtgggagtctaagtccctttgtaggtctctaaggacttgctttatgaatctgggtgctcctgtattgggtacatatatatttaggatagttagctcttcttgttgaattgatccctttaccattatgtaatggccttctttgtctcttttgatctttgttggtttaaagtctgttttatcagagactaggattgcaacccctgccttttttttgttttccatttgcttggtagatcttcctccatccctttactttgagcctatgtgtgtctctgcacgtgggatgggtttcctaaatatagcacactgatggatcttgactctttatccaatttgccagtctgtgtcttttaattggagcatttagcccatgtacatctaaggttaatattgttatgtgcgaatttgatcctgtcattatgatgttagctggttagtttgctcagtagttgatgcagtttcttcctagcctcgatggtctttacaatttggcatgtttttgcagtggctggtaccggttgttcctttccatgtttagtgcttccttcaggagctcttttaggacaggcctggtggtgacaaaatctctcagcatttgcttgtctgtaaaggattttatttctccttcacttatgaagcttagtttggctggatatgaaattctggtttgaaaattcttttctttaagaatgttgaatattggccccccactctcttctggcttgtagtttctgcggagagatcagctgttagtctgatgggcttccctttgtgggtaacccgacctttctctctgtctgcccttaacattttttccttcatttcaactttggtgaatctgacaattatgtgtcttggagttgctcttctcgaggagtatctttgtggcgttctctgtatttcctgaatttgaatgttggcctgccttgctagattggggaagttctggataatatcctgcagagtgttttccaacttggttccattctccccgtcactttcaggtacaccaaacagacgtagatttggtcttttcacatagtcccatttttcttggaggctttgttcatttcattttattcttttttctctaaacttctcttctcacttcatttcactcatttgatcttccatcactgataccctttcttccagttgatcgaatcggctactgaagcttgtgcgttcgtcacatagttctcgtgccatggttttcagctccatcaggtcctttaaggacttcccttcattggttattctagttagccattcatgtaatcttttttcaaggtttttaacttctttgccatggtttcaaacttcctcctttagcttgaagaagtttgatcatctgaagccttcttctctcaactcatcaaagtcattttccatctgctttgttctgttgctggtgaggagctgcgttcctttggaggaggagaggcgcgctgatttttagaattttcagtttttctgctctgttttttccccatctttgtggggaaaggtctacctttggtctttgatgatggtgacatacgacatacagatggggttttggtgtggatgtcctttctgtttgttagttttcctcctaacagcaaggaccctcagctgcaggtctgttggagtttgccggaggtccactccagaccctgtttgcctgggtatcagcagcggaggctgcaaaacagcaaatattgctgaacagcaaatattgctgaacagcaaatgttgctgcctgatccttcctttggaagttttgtctcagaggagcaccggccatgtgaggtgtcagtctgcccctactggggggtgcctcccagttaggctactcaggggtcagggacccacttgaggaggcagtctgtctgttctcagatctcaagctgcgtgctgggagaaccaccactgtcttccaagctgtcagacagggacatttaagtctgaagaggtttctgctgccttttgtttggctatgccctgcccccagtggtggagtctacagaggcaggtaggcctccttgagctgtggtgggctccacccagttcgagcttccaggccaatttgtttacctactcaagcctcagcaatggtgggcgcccctcccccagcctcgctgctgccttgcagtttgatctcagactgccgtgctagcaataagggaggctccatggatgtaggaccctccgagccatgcgcgggatataatctcctggtttgctgttttctaagaccgtcagaaaagtgcagtattagggtgggagtgacccgattttccaggtgccgtctgtcacccctttccttggctaggaaagggaattccctgaccccttgcacttcccgggtgaggcaatgcgtcgccctgcttcggctcacacttggtgcgctgcacgtactgtctgacaatccccagtgagatgtacctggtacctcagttggaaatgcagaaatcattcgtcttctgtgttgctcacactgggagctgtagactggagctgttcctattcggccatctataaaatgttttaaatatgcaactttccattgctcaaggcagacaggacccttaattggttttttaacattgaaattcattaactagtttagtaatagttataagaaattttctatgaaccatccagctactggtttaaggccctggggattaagaatctgtccttgcccagtaggagcttacattcgagtgggctagagaatcacgtaaatagataattgcattgcaatttgataactacaataatagatattcaaagtacaatgacagtactacttaccggtttccaaaatatttttgtacttgtctaatggcaagtatgttattttgcaaagatttgtttttctctccggtcaatacaatatacagggcagtggtagaattcttagatggaaaatacgcaatctatggtcaaactatttgggtttaaatgcctggccttaataactggaaaacaatgagaaatcatttcatctccccaagctttatcccagaagcagtaaaataggtataaaagggagtgcttttgggtggctatgtacagtcgatttatgctatcaccttacatctgggtctaagccagcttctcctggcccaactagatcgctcttgcagagactgattgcaaaatataaccctgaattcctcctatacagaaatgcacactcctttgcaatgtggctttcctgctcttcccatcaataggtggactcttacttccctatccccttagtctgggctgggcttgtgacctgctttgatcagtagaatgtggcagaagtgatacttctgaggctcagttttttgttttttgttttgtttcgaggtggtgtctcattctgtcgcccaggctggagtgcagtggcgtgatctcggctcactgcaagctgcacctcacgggttcacgccattctcctgcctcagcctcccaagtagctgggactacaggtgcccaccaccacgcccggctaattttttttgcatttttagtagagacagggtttcaccatgttagccaggatggtcttgatttcccgacctcgtgatccgcctgcctcagcctcccaaagtgctgggattacaggtgcgagtcgctgcgcccggccggagggtcagttttaagaggccttgcagcttccacttttgtcatcttggaatgttgctttgagacctccatggcaggaggccagtcttgcctaccagaggatgagagcccatgtggaagaggacagaggcaacccagcagactgccagcaccaactgccagacatttcagtgaggccatctcagaccttccagcccagctgatgctccagctgaatgtagccacgtaagtgagcccagatgaaagaaccatgagaaataataaatcattattgttttaaccgctcagttttggagtagtttgtgaaagcaatagataattgaagtacttaccgcatacaatccatatgcctcataataaaagtagcctttttaaggtagcctttttaaacacaaactgatttcataaatctgaattcctcatcacgtttttttttatattttttaattgacacataattgcatatatttatggggttcagtgtgatatttctattgatatatataatgtacaatgatcaaatcagggtaattagcatctccatcagctcaaacatttactgtttctttgtgttgggaaaattttaagttctctcttgtagctatttgaaaatatgcaagaaattgttaactgtgtccaggcatgctggctcatgcctataatcccagcactttgggaggctgaggcaggtggatcacttgaggtcaggagttcgagaccagcctagccaacatggtgaaatctcgtctctattaaataatacaagaattagctgggtgtggtggtgcatgcctgtattcccagctactggggaggtggaggcaggacagtcacctgaacccgggaggcggaggttgctttgagctgagatcaggccacagcactccagtctgggtgacaggatgagacttcgtctcaaaaaacaaacaaacaaaaaaacaaaaaaaaaaaaaaccattaactgtgctatagagcactagagcttattcgtcttatgtagctgtgaatttggatctgttaaccaacctctccctatccccacctgcccctatagttcccagcctctagtagcctctattctactctctactttcatatgattaattgctttagtttccacatataagtgagaacacgtggtatttatctttcaaatattttatggataagacctcaaaagcacaggcaacaaaagcaaaaacagacaaatggaattatgtgaagtaaaaggcttctgtacagcaaagaaaacaatcagcagtggagagacagtcttaccacatatatatgtatttttttttttcagttagcttcctcaggttgaaaaacacccatattttttaaaagttgtcttccctacatgatctggcccttcctgcctctcctcaccttatctccttccatctcctctcttatctctattctagccacactcccagaacatgccaagccttttcaggctccgggacttttgttctctctcttttctctttctggaattattttccccagactttaacatgcctgactctgtctcacatataagttctcacctaaatgccactttctcagcaaggtctttgactttctaaaatagttccaccctctcagccagccaaaacttacccaatttccctattttgatagcgcttatcactatctacaattatcttgtttatttatgtttccatttattgtctgttttttccaccttcccaagaatgaaagctccacgaagaccaggaaaagactgatgggccactgtgtgtccagctcttagaaaaaggtctggcacatagtacatgcttagtaagtacacattgaatgggaggaaatagctgttctgaataatgactcaaaataacagagggaaagcatctaacaggggacccaggtcttgagagcagcaccagcaactcaaatacgaacacacgctgctcttcctactgttaccatgtctgaaatgctttctttgtgctggacactgctaagcctaatatgtctgttatctcatttgtttctcatatcaacctcaaagttctaggttctagatttattatcctccttctaccaacaagaaaactgagtcttagaaaagttaaacaactcagataaaatacccatgatttaaattcatgaagtttaactctaagttccattttaaaataatataatgatactctgatttcttttcagattgtataaatctttcaccttttaaaataatacactggactattactgcctgaacaaattactgtttatattattattccacttttatccctccctcctacatgatgataatattttacttatgtttagatcctgaacaccaaacatccagtgaatacagctgaagatgtaaccgactgagtggttttttttttgtggtggggggcacagagtcttgctctgtcacccaggttagagtgcagtggcatgcctttgggtcactgcgacctccgcctcctgggttcaagcaattatcctgcctcagcctcccgagtagctggaattacaggtgtgcaccaccaggcctgactaatttttgtatttttaatagagacagggtttctgtatgttggccagactggcgtcaaactcctgacctcaagtgatccggctgcctcggcctcccagattgctgggattacaggcgtgagccactgtgcctggccaagactgattattaatgaactaattctacctatacaatttggaggtatgggagacagcatcatggagaaacctcatttgaagtgcaccttgatgaatggatgagcaagagttggccaggtagaaaatagcaattctaggggaaagaaacgacatgggaattttttcagtgttgtttttgaaatttacagaatttggaagaaaatgtttcagtaaggaaaacttcctgatggtctttatactgttttcaagttctttggaaacttcagaaacatataaaaagacacagtttttgaaaaagtggaggggaaattattagagagcatgtatcatccagcgaagactaactggatgacattcttaagtagtacttggtgtttgtccttaattgaaagatgtttgtgtggactaggaacatctaaatagacttttcaatctgtaaatgaaatcttcagagcctgcagggttctggttttttaagtaagtatctgtccgaggaatactctgcacatcaaataacttaaatccagtaacatgtgataactgttcagggattagcacactggattctattctctctctctatagatagatagatagatcactcttttagatagatagatagatagatagatagatagatagatagatagatgtgtatatatatagatatatctctctctatatatgtatatatatatctatatagagagatctatatacctatatatctatacatctatgtatatagatatagatcctgaacaccagacatccagtgaatacagctgaagatgtaacccattgagattttttttttttgtggtggggggcacagagtcttgctctgtcacccaggttagagtgcagtgagatctatgtatctatacatagatatagagagagatctatgtatctatacatagatatagagatctatgtatctatccatctatccatctatatctatctatctatctatctatctatctatctatctatctgtagagagaaagagcacacacttacgactggtttatcttaacaggagctttaggatgtctggaaagtaatacagtcttcataaagagaggttgaacattatcaaacagcatggttcattgtgagtttttgttttaagcattttaaacagttgacttcaaattcccagcagatggtggtggcagcaggcaggcactctagtcaatgagaagtcaaagtgaacttttaaaatagttgattcttaaacttggaagaaaaaggagtgaatgttagaaaaaaaaaataacaggtttcctgcaatgcatcttatcatgcacaagtcaaaaaatgagaaacggtacaatttgcaataaacacaagagtgtgtattttacactacggaaatgtaaagcatttaatcagtctgttagcagaaaacttgaatattagctgtcaccaaatccctttagtgtataataacctcagaattgcggaccaatgtgttttcctcccagcaaagcttaccagaagtgttttcttaaagactggcattcctattaataatttaaggtaggaaaaaaagggggtacattttcttcttagtagtccaatccacaatataatgatgatgatgatcttactatacttaataccactcttattgtagtgatttttcttttaatgctatttttggataagaggtaattatttttaattgttaaactactttctatagattttttgagcacttcaaagtctagaattccaggattctgtgaagaaattctttttcagccctgtcgtaaaaaaatttttttgatccttggtcatgtttatatttatcctgtccttaataatattgattataacttctcttttcagtgaatatattatacatgttcgactttatcttactaggtagctgcttaataacagccaaactcattatttatgtcacttatcttccccttttagttatctttgtgtttaggctcctactctatggcggtgaaagcaatggttgtgggagggaaggggaagttgcttgatgtaagtgaccggaaccacaagaaatattcccagtataaagtgaccctgtttgcagattacctttctgctttatttcctatgctgtatcttccattttctaggattcctcaggccatctttgcatggttggtttatcagaatgaagtaaaatagctccggatagaatttggcccctccaaatgccaggcccatgagatagcaaggaaacttcatcaaatgccaatgacaggaaaagagctgtatgtcttacgaagcaggcccacattaagtctgtaggactgcatggcttttctcttgccctagaaagtcaacagatgaggtaactccccacccaactggttccttttctttacttggatgatcaaggggtaaaagtacagctgtcattttagctacaaaggtacctttttacattaaactgaaaaagtgcacatgtgttctgttgaaatgccccctatatatctgttttgaatttcagttcactgaatgttctgaaaattaaataaacacaaaacaggacatgctaatatcttcaatgaggtgcttaattccccatcttaatcagccgttttccatcctgtttctttttcctgcctatctgtcaaatgtttcttaattaagaattattcttaattacaaagtttatgtgtcattttattttagaggtagttaattaaatttaacactaatcattggagatattgccttttctgcacacacattgatgcttaattattggaataccttgaatctcttgactgagggggagtagggcatattgatttgtgtctggtatgtggcagctcgtactgaatagggcagagactcagcccatcaaccagacaaagaagtaggaagctcattttttcttagttgataaaggacagtgaacaaatgcactctggtcattcagcgcattatgtgatgtctctgaggggcatggaagtgtgatgattatggatgacattcgatcctaaaaagaatagccagaataaagctattctttaagagtccttggatacttgttagaatggatttgccaatttttgtatgtatgggattatactggggtcaccctgagcaggtcatctggttggatgagaagcgagatccagtggccagattagaaaaaggatgcattagctcttggttccttctacccaatctttcccctccaacattctcagaccttatctcctgggtcacttcttcagagaagtcttccacaactatatattgcatacctttccttgacatcattcattctcactataattgcaatttatgtggttggatttttattgtctgcctcacccaataaatgaagtatccttgagggtagttgtcatttctaattttgcttatcatttatttgtcatttgcttaactagtatttgacactaaatatattttggaatggattaatgaatgaattattaaatatttttagaagctataagttatttgactttttaaaaaagtattaaatgttcattacgtttgccagcactgtattattaggttctgggagtaagggatggttgggtgaaagtgaatccctgccttcagcaatttataatacaatacaaaagaaactcatccaactaaatataatataagctagactataatatgtggtgtaatagatacatgaacccatctctgtgaaaacacatagcaaatcagccaagcgaggcaaggcttcaaaaagagggagattatttgaaatctgccttgaaggtagttttggacaaataagaactggggaaagggcatgctgggaagaggtaacaagatgagcaagagtcagatgtataaatgaatatgatgttagcaaattgtcaaagattggaaaacatggtggtgctcagtcctggctcggatacagtgaggcaggctttctgtacactgttggcaggactgcaaatgggtagacacttttggcaaaacacgttagaagactcactatttcctcttctagaaatatatttcataaccggagatgtgtgcaattctttatattcaaaattgtttctcacagcatatttgacaaacttcattaacggtctacacacataattgtagtccaatgattacatgaattatgtaataactataggatgaaaaactatgcatccattaaaaattatgtttttgaagaatcatgacatggataggtgcttggattgcagtgtatataaacataatgaaaatctcaatataaagttggataccagttttatacatgtaaaaatacagaggaataaaggaaataacagtaacagtaatttactaatactaattctctttggtggtagattgacaagtacgttccattttcttctgtatgttttctgttttctagatgttctacagttgtaaatattggttgcataataagaaaaacagatttaaacttggatatgttatgaagaaaatgcaatatcatatctatggctaaaatacaaaatgtatagggaatgcttttagaaaatgagtcttgagttttaaaaattatttagactctaatgggggttgtgccttgtattaatcattctgggtaccaggaaaacctgcgagatacggcccgccacccaaggattttaaaacctggctgagaagacaatacataaatatctaatttaataacaatctcagataatagttctagtaataccatggggcaggatgctacagattgccaaaacatggcacataagctatggcctagaagtttagagtagagattagcctattgagtaattatacagaatttctaaatgttttttgtcatctccctgccacacccctggagcagcgtgtgatctcaccagcagtgcaagggcacatgggctctcaaatacctgccatagcaacaggatcaggagatgacttagagaaggtggagaggagggttaagagaccccagaacttatatggctagaggtccaaaaacaagtagatgccactcactggcctgcctgaattacgtatctttccaatggaccccaacctaaatacctagatatgtaggttgtaccttttctgtatatgatgaacttgatatatgtgcaccccttacgtatgtatacacatgtatgtatattctgtatatatttgtgtgtgtgtttgtgtgcataccccatatatattcatgtataaatatatatatatatgtagaaatattttctaataatcactcagtttctattgcaggtgattatataaactctcttaaatggatttgccattttcattatttgttgccataaatttgcttcatcctaaaatactgcttaattactagattggtcaacaacatgtatcttgctataattgaaaaatgacttacattttggaaaagaataagatgaatatttttccagataccttgggaacaaataaattcctccattttgagtgttactgtaaacataaaatactagaatgggatattttttggatattcacttaatgtttttgtgtttgatcttccaatatgaatcgttatccattcacagatatttataaatcctctactaggtgcaaagccattgataagtgttgcaagaaaataaagtacaagttaaagaacatgagtacctgttgtctacagatactgagaattctagaatatataaataacactccttgaccatgaaacatttatgatctcttggaggaatcttgtgaggaaaggtgttgattttgccctcaaggcggttctgtcaaccttttctacctgtgggctgaagagatcaaggacctcttcatggaaaaggtggctcgttcactaggctctaggttacaattgttcttaacttttttttactgaggatgtcagagacccctttagtcatgtgatgaaaataattgtttcttacctgcaaaatttacaagcccagcatcttgtatttaatttcagtaatttatggattctttctaaggtaatccacgtgcatttagtttacagacccccacttcaatgagtagttagaatttggacatgcactaggctaaaaacaaaggcaattttaggtaacaatacagaagcaaagtgtataaagtatatatagaaaatggagagtagctccatttgaatacctggaatgggttaattaaagatctagactgaaaggtaggaattggttaaataaagatctagacaaaaaggatcaaattcctaattactgaaaattgcaccctgtatcatatcatatcatgagtccatttccagtggcctgccttttagctattattagtcatcacttaatccaacaaaagtgcccaatcttcccagtttcatttcaggacaagcctttagcaacaacaaattttgcccttatccttcacggagtagattttctctgccgccagcatccaaatgtgcatttgacactctgaaactgaaggagagactgggacagaccataccaatcactgaccccatcattcagagtgattgagatctgtcttgtcactttcctgtgtggagacattttctctccttagattctctataagacaaaacaatccaccaccattatttttatagcatgcccatctcccagagtgtcacaaactctttacaacaagaaatggaatagaaagacgatgctttgcagacttgggtatagttattttcagacagaaagggaaaatgacaagaagagattgagtggaataaaagtaaagataaggctgctgacttgaaaaaacagtcatgacaagattgatagaccctgcccaaatccacatctctcacctgcacacatgtacacacacacacacacacacacacacgcaggtggatagtctcagcagcttttatcgaaagttttgttgatgatgtggtcttcctgatactagttttcaatgatagaattacatgcttattcttgaatataagtcagtttggtctctctgaacacatgtccacatgttgaagttgaaatgagttaatggatgtaaacatttagaccagtgccttacacaaatgaacacacttcgaatgtttttccattattattgatgttgataatggtgatgaagatgatgatgattaacagtagtatagtattaacttgtttatcagaaaaaaaaaattgtggaacagaacaagaacccagtaaggtaataagtctttttaattattttgacatttgagcaaaggtaaacacatataagaaatctaagacttgcattctgttccttccctaggagtgttccaatatcctttcaggtagtggttatttcttaaaacgtccttttatcaccacctgccatagaatcacttgtgttacttcttaaaaacatggattcctgggctctaccttaaacctaccaaaaaagagtctctggggacaggtcccaaagccagccttttaaagaaattccccatgatgagtcttaagcctacaaatttgagaaaggtgtttacctatcgtttaaagaatcaaccttacaggcagggtttaatctgattaggaatagtggaggggaacactggctctgaaacatctttcaccactttccctgcaattcacactattaaatatttattcctttggtttccagtgtatatataggagtctccatttaaaatttaaatacaaggggaagccattaacatccattagcacaccatgtgagttagggatttgaaagccaatcatttagcaaggcttcaaggggagagtaagatgaatgaatcccattgaggaaaaaagagctaagaaggcagggagcagaataggccagcctaactgaagcattgcagctgagaatcctggacagctaggggagtaaggaaacaatgaattctgcagaccagctgctggaaacaaaaaaaaggagaaattatacaaagtggtataaaatgcttttcaaatatgtttgtggtagaggtggaccccaatgaccagttttgtctgtttctctttaagtgtggcctacagtagagtctaatgctggacccatgcatttgaaggtctaatactgagttaaagatctcggcataaatcctggggctaataacattggaccctgagcaagtcagacaaaattgcacctagatttagctaaagagtatcagctaactttgttttaagaataaacgttttttctcttcacttataaatactagttctcctaaattatttttcaaagtacttacataagcttcaacattttttccttgtctatggtcatatttaaaatagtttaacaaaaatttgttgcccatgttgttttgttgtaatctgtatgaacatctcattgtacagattaaaatgataaaaggaatcgggagtgctcaagcaagaagatttagggggagacaaagaagagaatttacttaaaagtgtaattagccaggccagggccttgttcagggatcagtgtgataatttatacttatctgaacttgtgaaacgtaaagattacattcttgtgaaatgaaaactacatttacttagcgattagcttttttttacatggcaattagctttggtcatgtgtatacatatacattaagatcagtaatatttatctgtcatcttttccttgtgtctacattagctaccatctggtctttaacctaaaaatgtccacatcaggaatcatctttatcagggtcaagtaatgggaataaaaaggcaaggtaacttttattgcagaactgaagaggagatttgaagagaagtaactttggcatcaagaatagagaagtaatggggagtgaatacttgaggtgtcctaatccactttctattaccttcaattggtgataaaaatgttaatgatgatcttcaaattcaagaatacacgtaaatccccaaggaaaccaaagggagcagtataattctttacctgactttcttgcatctagttttatttcagtttaggagctagcactgtcccatacaatacaagagcatttggtcttgtactaagaaaagacttagaaaaattgaagggtccttccaaacaaatgtggctgttttgacaattatgcaaatagtgtgaagattaaaaacccaagtaatcttcataggtcatggtattgatttaaatgagaaaacctaactgctttttgttttttgagttgtgttgggatttttctttttcttagtgtgttttttttgttgttgttgttcttgttgaagcatgacacttatctgtttttccttgctagattaaagccttgctttccctttgttatttaaatcacatcagcaaggaattaaagagccttagagcaggtggctgtggtttgggtttacattagtggactttttgccattatgtttctattccaatttccagtttcagttagcaacattatactctgtgattttgggcaggagaaaacccaaaccacagactaaactgatttttgtttggagaaaatgcacaaccaattcccaattacccaagttgtatttcaatcccagagtgcatggaatgaaaataattgcaagtgtgaatacacacaaaaagaaatacatcctgtacagaaaactagctccctcactgttggtaggagaagaaggatatttgctctggagtggtcagggagtcctgttactgaataaggcccttaacttgagagtacctttattaagaaagcagatgagtgctgtaggggaagctagcaacatgcatgatgcatgcagcctgataatgagatgcccttctagcaatatttaacccttacattaatccaaatctacctccttataactcctgctttttggattaaaaagcaaagtaagcccagtgcttctaacagtatgagagatcacagcaaatgtttaaaggcagtgaccacgtcacccactccacccaaccctacccccgacacacaccccatctcctccaggatatagtttcccggttactgcaatcattcctcagctccaaatctctatgccctttttcctttttctcttttccttcttctcaataaacagttttattgagatataattaacatataaaattgtttgatgtttgcttttgtgcatacattatacaatgatcaccacaatcaagctaatgaacatattcatcacctctacatggttactatttgtgtgtgtgtctgtgtgtctgtgtgtgttacacccttttctcttgatggtctctgctttcacatttcactaaagctgtagtaccccaacttctaagtcctgtgctctgagcacatgcaaagtttgaccatgctatcctctgctgtggactttcttatcacttctataagccagttttagtttatactgacatctgcccactctgggttgaattcctacctgctgtgggagaaaacaaacagtgtacaaatcattgccaccaaaaagtgatggtgtccaagtggagatgctttggaggtcattaacaatatgacctgaggtttaggaatgagagccaagctaaagatttaggtttgagattccttagctcagaggtgttaatgaagccacaggtggccatgacttggtctgtgaaaagggcagactttaaatagggaacagtgatttttcttcagcctagtaatgtttgtccacacagagtttcaatcatttaaatatcaagagatctaacagaaatgtctgtgtttctgatttccgttggtgatataaaaagagtggagttacatgtctgcagtgcggcaatagcctaaagctgagcagacattgccttctataggcagggcacatgctctttggttccctgaagttcccaccacttgctgctcagcaacttcacccatttacatgccagcctgtcttctgtagacattttaatttgcaatatctgatagacaaggccaagcactgtggctcgtgcctgcaatctcagcactctgggagaccgagacaggtggatcacttgagcctggaagtttgagaccagcctgggcaacatggtaagactctatgtcttcaaaaaaaatacaaaaattatctgggcatggtggcatgcgcctgtagtcccagctacttgggaagattgcttgtcctcaagaggtggaggttgcaatgagccaagattgcactactgcactccactccgaacaagatcctgtctcaaaaaataatatctaatagacaatagtaaacatatatctatgcctttgatttcattctctcctgctgatcattcagtcaattttttgtaatcgaatgggaatttaaagtgtgcctttttgatagggttttcatcaagttattagagagatgaaagccatctaatgttagtgtaggaagaaatcttaccaattatttattcattttacaaatggagagaatgaaactcaaagaggccagggcagtgaaactcagagaggccttgttcagagttgacaataagttaatatcacagggaggatagaactcaggtcacactgttcttcctaagtcttagaatctttagctattaacataggtactgactggtatatttgctctcaattgaacagaaaagttgagtacttgtatctggaagggaatcaaaacaacaacaacaaaagataaaaaataaaaatctgtaactactttgataacttattaaaatatgaaaatacagtatacagttattgaaggaattataaacttctttattgcagttgtgtttgaacagtgccttttaaaaaataatctgcttatttctacctattgagagaaatagctattttttcagtattttcctttggaccacattgagttttttccccaaacacagtttgtcattcaaccaaatgaaaaggtcctcaggcaccaccctccacccaagaaccaaaggaatcatttgatgtgaaaggtacgagtcatgccaggctcggcaccagccaattaccgattacacaagctgtattttatcactccaaatacatggaattaaaataattgcaaatatgtgtatacacacaaacagaagtgtatcatatgcacacagctccttgatggtggtagaaggacagggatatttactctggaatgagatgtgattcctgttattggacaaggcccgtaacttgagcccacacttattaacacagcatatcagtgcagacagcttgataatgaggaaacatccagcaaggttaactcttcagcaaggttagaggcgtgaatagtctcatccagttaccagctgaatatttttcagagaatgcccatttccctagttaagtgtttctcaaacttagctccctacgtgggtctttgtaaccacactgggaatgcatggagccatctcctgaacccaggccagtgagctaaacatttctgtggcccagtcactagtgacggttgagcattaagaacattgcaaatggtgacaatctaggaaccattaagctacagaacaggtccaagatgaggagatacgtccttacagaggtctaatgtagcacctgagaattacagaggtctaatgtagcaccagtcatccacagttgagactggaatctagtctaacacgacagagagttcgaaaggttgcagacataagaaagtaacagcagtgtgtgaaacatcacttcctgatttccttgaaagcaacttagttctgactgccaacctccatccagttcttgccaggttgctacggaagttgctttgctattcttatgggagccaacccaacccctagcattgtacacagaaaatggggaaggagatctaaattccagtcaaagttgccactgacattcccattgtcacatcccaagtggttccttgaaatatggctgctctcagctatctgccactagaaaaagaatcctcactgaagttataacatcagtagcttggatagcacctccctaggcacatcatggagcaagcctatggtagagggagcattttggctccatgcaaatgcctgactcccacagaaccacattttcctcccagtccagaggaaacttgccattcttttttgtgacttgcctcaacccatttgtctgcatcttgccagagaccacctgcttttcaatgaccttttaccattccttacaggagaaagaaacagaggcagagagggaaggagggaatggataccagaaagcaattaatctgcaggagagtagtggttcagaaggtcagaatggagcaaactctctgaaatccactctagaattagcagtagagcagctgatataagagacctacatttttcatgtagtgctctggccccagtttcccccacctcctctctcctatacaccacaatacgaatccagggcttctgtaaggtcacagagcaatccttgcctatctccagcacatacataaaaattcttaccggttcactgtttcacatatattctttatgaaaacccagtcatatcctgtgaggtaggggcgtgtgtgtttgtgtctgtgtgtattttttcattatgcccaaaaactaagatcatatgtcttctcatcactttctatttttgttgctcaggggaaaactgaacacataaacttagaaaagcagtcataccagcctatgaggtccagatgagctaataaatgtcctcttgtctttataatctccaattcctgtgataagatattagggcaataggttttccaaagtaaatttatattctattagcaggtagtgtgtattctacagcttctggatattttgctacaagtaacatttcagttaaattatattctctgggacaggtaattagaggtaaaattgctccccttttgggtacatgcatccttccccacgaatattctcatcaagaggcaaaggtggctggagtaaagtcccaagtgtgttcgtttctaagagaagccgtttagcatatcagaatgagcatgatctttgaaattgtccagatacgtagccccacactagctatgggaccttaggtaggttatttaactctctaacccttattttatcatcaataagtgtggtaataatggcaacatcacaatttaggcaaataatcagtatcccatccatgaaagaggttgctgttgctgcctttaccatccttaacaatatcctctttatttatggggaagggtcattatccatcatcaagtgacaaagcttgtctgccttacctcctagagcaggttcagcagactatagcctatgggggcaaatcctgacagttgtctgtttttgtacagcacatggactaagaaagacttcagctgtaaaaaatcaaaaggagaatattaacatttcataacacatgaaaattctatgaaattcaaatttcagtgtccaccaataaagttttattgcaacacagccacactcattcctttgcatattgcctaaggcaactttcatgctataggtgcagagagttgaatagctgtaacaaaaacccttgccccacaaaacttaaaatatttactattgtgccctttacagaaagagcccgtcaatgccctagccctagagaatacagtatagggaagaccacgtgagaaactgcttcatcacaaataatcagctttgcccttgtgatctttggtgtaggtcttgcatttggaatcagtgtttagtttttatatgtgctattttttaatatgtatggcttgtctctgcattggcagttaccccggcatatctcagtttcagttctgagtgaacgtgttgatgtctttgaggcattcctcaagaacgtctcaaaattattagttatattcctttattcctcattgatcatattataaaccaccttacctataatatgccctcatcgtttgttgaaaatttacccagcatttctacagtggtgtaataacaaagagtctgaaacataattttatgtataatatatgatggttgtggtggtggttctgaagaagaaagaggaagaggagggtagagggaaagaagaggaaaaagattcagttttactcccaatgtggaataatagcaggaagtctgttgtgtggctccaggacattatctcagttccaagctgagtgaaatcaaggtgggagttttctccactaggatactgagaatgaggaactcacaggaaagtaatagaagctattaattgcaggatctagtccttgcacaataatatttcatcacgctatttacctggagccattgcctcaggggaatatagtaattagcataactatcaacaacaatagcatgtatgcataagttaaaacatatgtattttgactagcaaattgtctcactaacaaaagagggttagatgtagtttcttggtgctgcaaaaatgtgcaagcaaaataaacaattattagagcttttttctcctgctgtttataattgaactgagctacaacccatgctttttcccattacaaatatatttatgacctttgttcgttagcacagaaatatatgtcaacatatgagacaactggatacctacctgctagggacggtgacatttgttcttactgctttgcagagtatgcaggtgtgatgaatgtcaacaccctgcgtccttgttattgttaggcagcagtatgcaatccacttgattttcatttagtgtgttggataaattaaatctcagattcttaaacttaagtggcacacttggacccatgagaagtattaagtttcttgctatgcaactggcaattctatctgcttattcacaaatatttgaaaatgcgatcccttgactaagtatttttgcaaatagcaggaggaaaagttggcaagaagcagctttgcttctaagagagtttgatgttctcctttcggaaaagcgatgaaaacctacagtgcccggtgctttacctccgctacctatgccctccctgcaggcagttccaataattttccttttcctgccagcctactttctccttgatgaagttcagtgaatatttaagccttgaggattggggctggagagagggagcattgatttcatcagttgttttggaacacgtgggatcttttctatttttccttttgcatcttttttagtatgataaaaattaggattaaatttatctttctgaggcctgttgctgtttatttctttgactaaaatatccggcaacagtatatcatgaacagctctctttcttaaaattatttcgtaaatattttttgtcgcacacacactggcgcatgcaaacactatttcgtttaatcttgtggtgactctgtcaagaaagggaaatagctttatagaaaaattctgaactaaagtgtgtaaaattaagatctctgtgtttcattgtataaaaattttagctcaaatgaacaaaagacctctcatttttatttttattttagcatttctttaccataaggttagagtaactttttaaaaatatggtagcctaaaaaaactaatgactaaaccttaaagactaatttaaaatttttatcaaatttttttctattattttcttaggaaaattctcaaacctattaaattcaaaagaatgttatggtgaacacctgtatgcatgtcaatgagatgctaccttcatgattttattataaccagctatccattctccatccacccatcaattcacctttatttttgatacattgcaaagtaaaccgcaaatatccatatgtcttcctaaatacctagtctgcctatcattaattagtatttgatatttggtttacagctttttgtttctttgagctaaaatttatataacctgaaacacacagatcttaagtgtccatttcttgagatttgaccagtgcatatttctgtgtcaacgaaatccccagatatatcaagatatagaacagagttatcacaaaaatctcctccggtccctgttaagtcttagttgctttaaatcaaatatcagttcaggttgattttataaggttttctttaaaactgtttagatgcaggcagaatacaaaagatgaaaaagacatgatccctaccctctaaaagcatatagatggtgacaaaaaccaccaaaatagaaaatttcaattttcaatatgttttaaataataacatgtggtagatgctatggaagcacctagcagtgtctgttcatccatctggactctcaggaaagggttttggaggagaagtcagctttagtctggagagaaaaaatgaataaatgttagccaggagaaaagaatgataagagaaattgctccaagaaatagagtacgtattttaaatcagtttctgctgttctagtgtttgggagaatttatgaatcagagcacaccgaggaacttgcatcgtcctctcaagaatactaggaaacacatcacaagaattcattgataaactgagtctctgtaccccaagggtatttccactgccttccaccttccgagttgctgggccccaacttctaagaaggacacttctcaaaccttcagtggctcctgtttgctgctattattagacacattcttcttatcctagcatttctaggtgcctttcatcttcccagtatagtcctaatctgactttgccccacttccccgtttacttacatcttatactcaaattatattaaactctccagtcctcatactttcctgctaggatgcctttgcccaagtctttgcctgtttctggaatcctctctctttaatgtctacctttcataaccccgttcatctgccaagtctttccccctgcccatcagaagccatcttgtctaaaaactcccatagttccttgctcctaccattcccacttttaaagccaaacacagctgttttgttctgctgtagctgacaatgtctagcacagtgctcagcacaaagtaggaaattagtaagtatttgttgaataacagtgagttctatcttatgtcagtgtgtacttatagatctagagtttctctaaagcagagtctgtgttctatacttctttacattcccagaaatcataaaggacagtcaagaattgaacaacattggccaggtgcggtggctcgcacctgtaatttcaggactttaggtggatcactttaggtcaggagttcgagatcagcctggcaaacataacaaagccccgtctctaccaaaagtacaaaaattagctgggcatggtggcagatgcctgtaatcccagctacttaggaggcgaggcaagagaattgcttgaactcaggaggcagaggttgcagtgagctaaggtcgtgccaccgcactccagcctgggcaacagagtgagaccctgtctcaaaaaaagaaagaaagaaagaaattgaacaacattaaataaacctacaatgctattctaatatctgagctgtagcattacagttctatttatatttaatacaaatttaaagaacatgtagtttgaggagtagacctcacaacgtttgtttttgtattagtatacttcaacccctctcttactacccctgaaggcttataaatgaaccgtttggttttaaattttaaaaaggaatcttataaattaagtgcagaaagaaaatgggaaagtccttgatatggtaaatgtttagttttggagagaatatcaatgttatttatgtagtcagtgcatctgttgactgactacctattacatgccaggggctgggcaaaaagcacctgtcctggtgtagcactgtttccagtataggaatatcttacagcagaccccagagaaagagttggactttgtatatttgggccctttgatttgtgtatgagaaacgtattactgagtgaatggaagccttctgattgcagataaccccaattattggaaagttcttctttatagtaagctttgtactgcctctctctaacatcttccagccagccctatttctgtcactggagcctccagaaccaagtaaacccctcttatgcacagcaccttttcagtattgaagatttacattacacaccctacccccaagcctcacctttttcagaccaagtatatagaactcaaaatactttttcaaaggaattggtttccaaattgctgtttgttttttcttaaacattttatatcagttccaacatctgatgtcagtttgatgtcctcctcagtttattctgtaacaggttttgtgatagacaccagcagagggatattgggggttgtggggaagggatgttatagagaagacgaacagagcataatctttgttgtcctaaagtatatacatggcaggagaaaacaatcactttgtcagatcatttcaatatgatgctgcaagtcatgtcagagataagcaatgggtactgtgggagcactcgggtaatctagtccaatctgggttttagggaaagaattttagaagtgtcaccagagttgagtctgaaattatgagcaaatgttttccaagagaagaatgataggaagggagacaatagaagttaaggcactgaggtatgaaatcagtatagggtggtaggggtgggggtaatgacactatagttacttatgtgaagtattagctcgagaatggcagaaaatagggcttgtgaggtatgtatgtatatacacatgtatgcattatgtgtatatgtgtgtctatctctgtaagtgtgtatgtaaatacattctgattttctaattcttagattttgccccaattctcttgttagaaattagaattttggctctacggccaaggactttattcagcatattagcttttcaagagatcataaataatcatcgttgataactataatgacctgaagtgttataacaaataatttctgcgaagtggagttttaggtaatacatatcattaaaggcattgctatgagttgaatgtgtgttccctccaaagttcaggttgaaacttaatctccatcatggtggtatgaagagatgaagtcttttgggaagtgtttaaatcatgagggcatcacatttatgaatgaattaatgcacttataaaagaggcttcaaagaaagtttgctgctttttgctgtttggctcttctgccatgtgaggacatagcattcctccccttcagacgacacagcctcaaggcaccatcttggaagcagagcaaggcctcaccagacaccaaacttgctggctccttgatcttggattttccagcctccagaactgtgaaaataaatttatattatttgttaatgacccagtcttaggtcttatttatagaatcccaaagggactgagacagtatagttataaatcaatgtcaagtttcttccagtttcttaatatggaggtttgccatttgaggatgcttcattgcttctctgacctgaataaagtagcatatatgattctcattatactattgatatttaagggaacggcttacatccatttcataagagttgtgtctcatgaattatttgtattccagaaaccaaactttgtctggagcatcccaatttaagatagccatttgttaagttaattgccatgaatgggtgacatttaataaagtatgtgaatacttaggaacggaaggttgcgaattaaaaaataaaattattctcctctttattcagtttcgtatatcacttaccaaagctcaccctgcctattctatggtgtttgagttcatgcatccagacttgtgttaagaagaagggtgacaaatttagaattcacagtgtgtgttgccatgggaaatacaacaagctattaagaaattgtcttttcaataactttttagtgtaattaaggagatcatgcatatgctcctggaaagagagcctgtagtattgagtactagctaagtgctgtgggctgtgtagacaatgtctgtggtatgcctgcccagtgactgtttctcctgcttttgcaatagcattttaatttttctttggagaactatacctgtcctattttcagcagtccatttgtttttttctgagcatccgtctctgtctcccagacttaaagagatccaggttggaatactcaaaatccaccctcaaacttgtgctgaatctatgtggaaaggagatgtgcctactcattaccatgtttgtggtggcagaatgtcaggttggggttgccagtgaccatgtttgtccccacaaagaagagcctacctgaaaatacagacagcaaaagacaatggatcttaagtctttgcaattatatcagacaatatatattttttcttaggctagttaaagttctccatcacttgaattagtcatggtttattcagagaagcaaccgatacgatgcatagagagagagaaaaaaaaagatacttattttaaggaactggctcatgcagttgtgagggctgtcaagtctgaattgcacagggcaggctggcagtctggagattcagggaagagttgatgttacagtcttggagtccaaaggcagtctggagggagaattccttcttcagggatctcagtcttttaagactttaaactgattggatgaggcccacccacaggttccagggcaatttgctttatactactgatttaaatgttactcacacccaaaaaacaccttgtaacattcatccggactgatgtttgactaaatgggtacgatagccaagccaagttaacacatgaaattaatcatctcactcctaaatgaaaacgccgtggctaatctatgcagtaactactatagttgctcagatgttgcagaaattatcacaggactgatgtagtcaggagaggttgtcaagagaacatactatttcatggtaagttataaaatccatacttttactattttgtaaataaggaatatcttttatggctatgagaaaattgaataagctgatacacatgggaggcacctaaatatttaattttctctcccttttcccttccatttatatatttgagtttctgattaagcctgtgttgtacctgagtctggaactttgcaaggcactttatgttgaggatttatgttttagagattaaatgacttcatgcggaccacgccgtaatctaagggtctagagctcagagtgaccacagcgaaggcactgagccttgtacttattttacaaataggaagctgttctctgtggtgattaattttttaaaaattaagtttcagtgctagtgttctttgccagtcagatgtctacatatgtttctaagtccgtacagctagaaagtgtgtgtcaaataaaagagttgaagttacttagctcctggcctcatatctatttcatcatgctatttaggcattcttttaagatataaaaagcaaaaatatgtaaaaatagccatttctacatggcagagtctgttttaagagcctggccaacactttgggaggccaaggcgggcggatcacctgaggtcaggagttcgagatcagcctggccaacttcgtgaaactctgtctctactaaaaatacaaaacaaaaattagccaggtgtggtggcaggctcctgtaatcccagctacttgggaggctgaggccggagaattgctggaacccgggaggtggaggttgcagtgagccgagatagtgccattgcactccagtgtgggcgacaagagcgagactctgtcttaaaaaaaaaaaagaacctgggattgttagattgttagtatacctgtcccaggtattttatttctaattgggagactagcttaatgcttggaagaatttgatgatgatcttttaaaatgtcaccaaatctaatcactcagccctaaaatacaccctcagggtataacttcagattaatgaggactaagacttgttgggagggctttggagtggaaatttccaccattgttaatttgcaggaggacatgtctgatgtgtttttgtgatggtttcacatctgacagtctgtctcctaggcacctggctgttctccactcggttccttcctgaatgttgcgctagattgtcaaatgccacttcagactagatctgtgcccccgaaagtcatgtgcaacttcatgaaaaaaatctacctgacattttcaaatgcaactcacttgaacttgtaaaagtcaggtgtaaattgagaatagatttgcacctaagtcttctttggttgatttcagtatttgcttggaactgacatttggagaataactcagttgccctcagaattggtcccctgctcactccaaagtgttgtcagggagcgcttagtgtccgaatggctagtacagtatgcttcaggtgaatttcaggcacttttatttactgggtttggaccagtttggaatggaaattaacaatatgtgaattcagtggtttcaccagtgtagcctcttgagcaaaccttggacactgaatcatatttgttgcctaaagatattaatgattatctggcttagcctcatgggcctgattcttcttcaacagtaatgtgttgattattggcattttagacatggttggtattatacagctgaatctctgcacaaattcagagcagctatgcaggcttctgccactgggtgagttgatgaaggagatgatgtctcctctcataatgctgcaccaaacagatggaatggcaagctgtctatgactctgagtatctctgaacatgaacctgtccttctgcctaccctaatcattccactttcacgaagtgcatgcactactgagccacagagaaattacacagcaagcagtagacatggtgcctgaaggcaatgcaactcttgaactggaaatttagcacacatgtgaaatccttcgcagatacaaagccgttcttagactattattttcaaaggtaaaattagagatgtaataaccttatgagatcatcatgtccagttctctcattctagagatagtaaaactgtgatccagaagttaagtcccttacttatggttatatatttagaggaagagatggggcaagaattccaggtccttgcacatcacagtattatccttctaatagagggtgaccaatgaatgcatgatttggtttgtaagcaaatgtgaaatccagagattttcatcatttccaacaatgcaaaaatgttgaatcttagactagaggctctttgacctcttcctggatttattctgtttctctttttacattcctgcaaggaaggactcttgatatatttttgccttgtagaaatattcatttctaagttggtttgaaattagcctgtcatctgattcactgagatagagttaaaataaattcccctggcaaaaaaaaaaagaaaggattttatcatctatatggatcaattccaagagttcgcttcagtttactgatccgttttccctacagtataggatattcaattaaaccttccctcaaattggccatgaattttgatgaaaatgaaagaagtttcgtttagcaaacagtttctatcagggactataataatagaatgcaataagaattattttcacctatgcacctgaacgaacatgttttgtctggtttttggtttgatttctatctgtatctttatttttctctttttgtttttcacccagattttgtgtagcttgtccaaagtggttgagatgtgggatcaggtgaaattgctcatagatacaataatgcttcacaccagtgttttcaccactgatttagtagtgtctttgataaactcttataatattccatacttacatctttctgttttaaatagaactgctgggatatgagttatgtctggtactcccttatttttattaaagcatatatagaaatttttcataccctttgcttcaggccttccttgccccacttagcatctgtagagtggacataggcaggaagagcccactctacaaaatgcatccagtatattttgagtagagactgattatggttactgatcttggtcctggaaatgagaaatgaattagatacagatggtacctctgtggaactttagagcaggagatgaagcaaaacgagggagaagacataagtgaggataacagcacacaaagtggtgagcattgccagtgaaaatgcagtggttttccccccagcgtggggtatcatagatgaaagggcgtttgagctgcaattcagaaggttctgaagatccacttatccaatttgtgttttgctttctctgtgaatggtttgagccagagctatacagggaggtgggcagtggggacagcgcatgcgtagcattttcacaaatgcttcatagggctagacagcagtggtaacatccttagccccaccccatgttttacagatgagataactggggctcaacaaggttaatgacttaggaagtcataaacactctgagctttaagccctcatcttgtgatttctctttcatggctgttttcaggaatccttaattattagattgctgcaaaagtaattgcagtttttgccatttaaaagtaatggcaaaatccacaattacttttgcaccaatgtaaacaggatttttatgatacaagtaactgaaactgactctagataatttaagtgaaaaaggaattgattgaaaagttagcatgagttctccaaaattatggagatcttagccagattcagaggaaagaagccagggtagagtgaaaggtattaggcaacaataagatcaacagcattctcaggaaaacctggccagtagaatgaatgggctctaagctttgttgttttctatctctgtattattgctcaggatccaaaatcagagagaacaatgtctgattgacttactttgaagatgtgccagtggccacccgtttgttaggggagagctaggcatcttgatttacaccctactgtgacagcacccataagtgaagaggtaatgccaccaaaggaaaccagagtggatgaccagcaaagagcatatgtccactgtgggaatacaggcacatgtaggtaaaagaacaaacgaacactgcaagtatccgtatggataaagcaacaaatcattttgtaggcctgagttaacaaatgtgatgtagcatattttcattataatattaagtctatgacaaatatattctgtgctcagccaaagttggtgaggcataacggcacttcttccataagctatggctacttgttcctccttgtgccctctggcatgcagataattaggcaaaatttaaaacagcttgaatgtagtagatgctctctatcaaggtgtgagggttaggatagcatttacccccaggcttaaagtgttctaggacatcttttgggtgagctccctccagaaagaaaaagtgttcctgagaaagggcagtatgattaatcttacctagaggctgaagcacatggtgcatattcacgcaatcgttcatgtgcacgtgaactgtatggaaggatatagctaaggacaaaaaggagttttccagcacaaattgagcacattaggctattatgaaaccattagagatttcttttgtagtttgttccgtatacagcagtctcttgcctgacttttcaaaggaaatgtggtaccaaagtagattccaagggtaagacccagttatcttggttagagtgtcctttcttgatattctcaggaatgtgttcttctggtaatttctgtaagttttcaaatgaaatgggagttactattccaagggttttacaggtagtatctaattcaattatcacagcactaggcaatagttattcttattatcctaattctacagaggacgaaacggaggcacagagaaggtttagtaaattgcttaagatcatcccttgtgcatttcacaagagcagagcaggagtagtctccccttcatatttacgtcatgtatgcctaatatagtacctggtgcagagctaagattgaatgaatgagtacataaattagacatgttatggtacagtatgagtatatattgcaatgtttgtgcatcactgaatataatagcttacatgaaatggaaaaaaactacctagccttttaaaatgtgtttatagttttcatatccattagctcatttgatttttataagacatgtatttagttggagggtataattattattcttttttaacttaaaatcaaatctcagagaagatggaacttgcccatgtgaaacaatcataacagttcctcattataaatgatatagggtactatgggacaaagaaatcttcagtaactttcagtatctaggaatctagaaattccacatattagcatagaaggcccaaactagaaactatagataaaaaataaaaccataaagaagttattaacttaaataaacattaaatgaaagaagaaaacaaaattgtaatcatagttacttgtaaaccagtgataactgcacaatacatcaaaattggcagaaaatgcaaaagccattcttagggggaaaaaacatagccctatatgtgtttatttgaccaaaaaaaatgaaaataaaagagctaagtattacactacaaaatgtgtttaaaagatgatagtgtaaatataaagaaagcaggaaaaaggaaatttgagtctagaaaatctccatataattattagggaagaggagaagagatgagaaaaaagaactaggcttctttccaagattaagttgatctgggctaggcatggtggatcacgcctgtaatcccagaactttgggaggctgaggcaggcgggcggatcatttgaggtcaggagttcaagatcagcctgggcagcatggtgaaaccccgtctctactaaaaatacaaaaattagccaggtgtggtggcatacacctgtagtccccagtactcgggaggctgaggcaggagaattgctggaacctgggaggcggaggttgcagggagcctagattgtgccgctgctctccagcctgggtgacagagcgagacttcatttcaaaaaaaaaaaaaaaaaaaaaaaaagttgatctggaacacatgccctcttatacataataccatttcaagacccctttaaagtaaataacaataaaatagatactagaaattgaaagtacgatatggctctaaaagtaaaatcaatttaaaaaatacaacaaaaatgatttccaatggcagaagaaagaagagaaaataagagaaagaggacaaaacaaaggataaaatgggttatctaatgcagtgacaaaactggcatccttttctggaagaacttcatagggtacaggctggaagagtggttctcttgaacaggcatcagaatcacctgcaggacttgttcaaaaacagattactattcccactcccataaaatatggatttagatatagaccataagattgacttttaaaatacatgaataggttcacatttttataagacaggaacatttacagaaaatgaaatgagagatgttcaatacaatactttaagatgtaatgtatcttattaaaagtggccatagatgacagttgaagtttaagtcttgagaaaactatgtttcttacagaacattaatatacattttccttaaccatctcaacttacagtctaaacactgcgtgagtgatgataggatcaaagataactggagcattgtattaaacatatatttaatctgagtcctcaagaaagtgttgcaatttaaatatatatagacagacatacatatgtgtgtatatatatatatttattaattattaatttgttatttattaattccaaaggcatggtacagagagctgcataagaattctcagctggctttgggaggccgaggcaggcggatcacgaggtcaggagatcgagaccatcctggctaacatggtgaaaccccgtctctactaaaactacaaaaaattagctgggcgtagtggcgggcgcctgtagtcccagctactcgggaagctgaggcaggagaatggcgggaacctaggaggcagagcttgcagtgagccgagattgtgccactgcactccagcctgggcgacatagccagactccgtctcaaaaaaaaaaaaaaagaattctcagctggttaatagcacagccaggtgtacatttgattttcaatatatatatttatatctatatatataaatatatatatataaatatataaatatgtatataatatataaatatatataaatatataaatatatataaatatatataaatatatataaatatatataatttataaatttataaatttatttatatatataaaatttatataaattttatatatttatatataatatataaatatatatattatatataaaaagtatattatatatatttatatattgtatattatatataaataaatatataaaatatataatatatacaacatataaaatatatatgatatatatgatatataatatataatatatatttattatatataatacataatatatatttgttatatataatatatataatatataataaatatatataatatataatatataatatatgtgtttatatataatatatattttttatataatatataaaatatatattatatataaaatatatgtaatatataatttataaataaatatataatatataaatatataaaatatatattatataaaatataaaataaatatataaaaataaatatatataaatatacatatttatatagatagacacacaaacatatatatataggcttttaaaacactaagtgtaaagttctcatcttctttggtagagattagacatctattaatctagcagaatagccaaatgactacagaaaatcatttttaaaatacgctttatagaatagggggaaaacccagtgacataatgcataatgcctggacatcacaatagaatgtattttgtgttaatacattctgtggtttatgcccaacactatgatcagtgaaatctgcctggtttccatccactcagactacactccattgtcatttctgagaaaatagtagcatgattacataaggaaaaatgatgcatgaggatgtcttgttaactttaaggaaggtgctctaaaatatgaatcagcatatagaggtggttgtattgatttttagtattataatttgactctgaagtcacatttgcaatttgcgatttgcaaaagagagtgatatcttgcatcatcacatcagaccacatagtttgcacactttatgtaatattggggaggtagagtggggtggatatttcatcgcaaatgaaaaatgcaacagtttgtttctcgggtgagctacctatggttatttaatgtcacctgccatagcaaaatactgcttaatctatatgactgggtagatgggtgctaaagaacaattctcttttaactttgctgcatgtttaaaaattttgataacaaattgctagggtaagaactaaaagatcacgtagattccagagccaacctaccaaatttaaatttcatctttcctggtatgaccttggacaagtctcttaaggtctctgtgcctcagtttcctcacctgtaaaataaacactcattaaattgtaatgaaatttgagttaacattttcaaagtgcccagaagtgtaactggcatggggaagcactagattatgtgtatgtgtgtgtgtgtgtgtatgtaattataaaataaaacttcaagtcccacagagtggctcatgcttgtagtcccagcactttaggaggccgaggcaggtggatcgcttgagaccaggagttcaggaacactctgggtgacatggtgaaactccatctctatagaaaaaaaatacaaaaaaattagacgggcatggtgatgcatgcctgtagtcccagctactcaggagcctgaggtgggagagtcactggaacccaggaggttgaggctgcagtgagccgagatcacgccactgcactccagcctggatgacagagcaagaccatgtctcaaaaaaaaaaacccaaaaaaaacagaaaacttcacctacaatttggtaaatatccttgtggtttgtttttacttgaaattataggaatttaaattcaaaaatcttttaggactatttaattcaactcttaattccaaaggggtagtacagatagctgcataagaattctcagctggttgatagcagagccaggtgtacatctgcttttcaaattgaaagtcccctaatattgctaacacactagaatttatcttttggcagtggcagggaagagaagttagcagtttttgttattttaacttaattaaatattgtttgatgcttctttttcttttgttttatttgttttttgttttgaggcagggtcatgctctgttacccaggctggattgcagtggcttgatcatagctcactgtaacctcgaactcttgggctcaagtgatcctccccctttagcctccctaagtgctgcacataccaccacacctggctctgtttgatacatttaaataagttaaaatatgtttgaattttcacaactctgactagatgtcatgtgctgaagcatttgcgagtaaggtagcaaatatttagctataatttaagctaatgaaatgagtctgaaaagaatccaataaattataatatgttactattacttcccataagtcattttgatatatggtagaattttaaaaatgattacttgttttatataataccaattcattctattattggttcttttggatgctgagaaaacaaaatatgaatttaaccaattgccttcagggtaggaagctgatcaaatacattatctttaagattggcctgtattatatttcaaagtttcaatgggttaatctcatagttatttacttcaaaatgaaggctggtgacatgaagttaaaatatataattctgagctttactacttaccttgaaaaactaatgatgacaagatatcttcatttgctgatgatacaatggcattttaaaaagaaatggggtttccaacaaaaagtaatcatttacatccaaatacgacttaaaaggtaacccatatggaccacaagaaatgattataattatctggaaagataggaataaaggattaccgtaagagactctgtccattcttggaggggatacgttctctagattttagagaattaggttatctctagctgctgtgcggaagctctgggagataagcaatcacttcagtgacaaaactgtgaagttttaataaaggagcccattggtatgggactgaggctctaaaactgtggcctgatgtcccacatcatgaatattcaaaaccttaaatctggagaccttcatgtacttcctagagaggcaatccattccctcctacccagagagcacgtccatgcacgcaggcacgcgcacgcgcgcatcacacacacacacacacacacacacacacacacacacacactgcccagaagaaaatgataggattttttcctagcatgaaaacattattattctataataagtacacaaatgcagtttttatgttgaagataaatcttttttaaaaaggaaactctccattcctttgtaaaatattgtaataagagaacttttaagtgtatacccaatcatgtatggatgatctcctgtgtcgatatcgcattgcagaaatccatgtacgtattttaatgggcgttgctacttggatcttcagaatacatgatatatctcttctcagatatctcatagaccatcccccctctgctgccactgaatttcatttagacctcggtggctgagtttttaagctagatcgttacaaatgaagccttaccatttgatgaaaatccagcaaaaatgcatattgcatttacaacagacaaaaccaaattttattggtaaaaataactatttcttttagaataaagaatgtatttatagttttgttttgtttttaaatcttgaaagagacctgaatttataattagtacagtgtgattctcaaccttggctgcatattagaatcatctgggggtccttaaaaaatactgatgcgtaggtctcacgcctggttaggatttgattggtaagggtacaacctgtgcaccagggattttcaaagttccctcaggtgatcatcgtgtgcaatgggggatgggaactactgaaacctaatccccgcaattacagggttttatatcgtttgcctcaggctaaagatttatgccagacttctagaccagtctcctttccaattccataaaatgaacaatttcacatattgaaaaatgtttttaataattaatcatttaaattccacaatgtggctgggtgcggtggctctcacctgtaaccgcagcactttgggaggctgaggcaggtggatcacttgaggtcaggagttcaaaatcagcctggccaacatggtgaaaccctctctctactaaaaatacaaaaattagccaggcgtggtggtgcacacctgtagtcccagctacttgggaggctgagccaggagagcccgggagtccagcagtgagctgagactgcgccactgcactccagcctgggtgacagggcaagaccctgtctcaaacatataaatacaaaaaaaaaataagaataaactccaaagagcatgtttccacacttaatgcttattgctgaaaccctcctttgttaacattttaaattgtcgctctatagatgtcattagttttcctcttgaaaaggcactgattaaaaagtaaattattagcactaggtataatattagttcgaaccacagttagtaaatacagaacatgctatctaatgaaaatgtcttatgagcatttcggggcatcactttacatgtgagcaattttggtttttagttgtgcagtctgtgagagtgattttgttagttttgcaggcctcagaaaactccagataatttaatggcacccatcctgtataggatgtgtgtaaagcacttcacaggttgcctatcttggccaaatgtaagaagcaattggagaggcaaaggaaaaagcagtcaggaataatattaactgtgcattattgtggcagctttattctggcttttgttgtattttaatagtgacagctgcacccagaatttcttgtttccataactagtgcaatttccttttcctgaaagctctgtgtagttataacctggtcttttgttttcctgcattgactaaggaaactaattttttttgttactagacagataaaagacaagtgttaaaaggtgtcaattgcattttttttaatatggagaaagtgtccaatcttgtggtctgtcttcaactaattttagatatgattttatttttctggccacccgtggacttgtcacaaattaattaaatgcttcacttcttttatctaattgaggccatttctacctctgatgaataatttcataaagtttgttacaaaggaaaatgctttctgagtgatagtttatgcaaagtaaacacacagaacagctctatttgaacctttgcttgtggcaaaggctttccatacactccacaggaagttgttccctctcaaagaaggccagtgtcttccttttttaacgtacagcatgaaaatgtacttgaccccaagcttcaaagcagagaagtcagctttatctagcagggacaatgcgcattaaatcaataaaatggcaggggtatgaaaccagtggaattgggaattggattccagtcagggtcaatcagcccaaagtagagatctaatattttctgaatgaactgtttgaagcactggccttcagaatcattgtcagtttttgatgacttcctcaggcaacatagtgtcacacacagcaagagggtcacaaacccagatgcctacaggggccggatacagaaaagaaataagtgaagctggctaggtaggagatcatagacagtgatggagactcggtcaggactttggtcagtgcctgggtaatctcacacagtcagcacatagtgagttccagccagtttctgcctcctgggaatgctggagtgttacaaagcctcctgattttttaagagccgctatgaatcttttttcttttaaatgttagaaactcatttaaaatatatgaaagcagacaccagccacaaataggtatttttggagtcagagtttgcataagactttagatatgatatattccaaattccctacttttctgaaggaagaaggagggaagaagaacatcaagaattggaggacatttaggatgatggcaaggcctctgaacgtacaaaaagggggtttccatcagcaccactcttcaaaccagaaatgctaaacgcagagaggattaacatggcagaaggagaattactcatttagtatcacctctttataagcaaggagacttgtctagtcacccaactgctgagcatcagaactgggaccaggcaatactcatagtaaaattagaaaacttgtgaaaacctcagggagaatataaattccagttcattctataataaagtctcaaagaccaccaagggtaacttgtacaagtcctatcattagttagggacagagcctatctaccagttgtatatggtacaaatatttttgagcatatgaatatgcaacaatttttttaaaactcttccttcattatattaagactttttaaaaaatgttatttatgggatagtttatttatcagagggctgctgggttcatctactctggctgctaatgacagatgaatcaccattcagcatttactgaatatacattcattaaaaatgcagtctatggaggctctgtagaaatatggaaagttgttatcagtgcaaaacttgaaataaaattgtatgcacattgttataactatttttatagttgaattgcaaaaacttggaagggaaaacaccaaaagtatctgttaaagaggtgaaattagaagtgattttttaaaaagtcttctgcattattatatggtgatattaatttcaatttaaaaatatatagccacgaaaataaattattacttgaacaactattgaaagtccagcaatgtgctagttgccatagggagataaaattctattagctagtatagaggagaaaaggtaacatctttttctcacccattgcagggttcatgattaagatccctgtaacagaaaaccagattaacaacagaaaagcatacagatttatttaatataagttttatggaatactgaagcctacagaaatgaagacctaaataaacagggtgtaatgttgtaaaatatatatttggtcttcatgccatgtcctggcatatgatttctaaaatctttggaatctccaaagtgctgtttttctgtatgctaatgttgactgaccacttcaagatgggtctggtcaccagaaagacaaagtcatgcttagaggattggtactttcaaccccaacctttggggaaagaagagggactgaaggtcaagctgatcaccagtggtcactgtcttaaccaatcatgcctatgtaaagaagccttcataaaaacccaacaggacagggtgcaaagagcttccagaaagctgaacccatggaggatcctggagggtggctcacccaagcagggcgtggaagctccacgccccttccccaatacctcgccctatgcatgccttcatctgtatcctttgtgatatcctttatgataaccagcaaacattgcgttcccctgtgttatttgagccactctagcaaattaattgaacccacagtgggtcatgggaacctcaacttgaagccagtcaggcagaagttccagaggcccaaatttgcaactgatatctgaagtgggggagcagttttggggactgagtcttcagcctgtgagatctgaccaggtatattcaaaatgatatagaaggacccccaagtggtatctgctgcagaattcattgctcacttggtggtgggaagaaaccccctcccacgcacacacatttggtcacagaagtcttctgtgttgatgattgctgtggtgtgaaagcagagggaaaattgtttcagttttttctaaacacaaggaaaactatttttatgtttacatttgatgaagagtggaaagtcgtatagagatatgattgaacaaaaaggggcatgatctaaaggaaataaacgggggaacttagcacggcctgtttgttcagcttctccttagagtctctaccttcattcctttcctctggatatagggaggacccctctggaatgcaggtcttatgacctactttagatgaaggtcagaaaatcttttatgtcctgcttcaggggagaaccacaggaggagattagaaagaccttcctgcttctgctgtttgctgaagtgacaatatgccatattttggggtagcgtgtcctgaacctaatcaataggctcacttgtaaaatgagaatgttgagagataatgaaataattatagaaagaaagaaatctgaaatgaatgtacaaacaataggctttagattctcacagacctggatttttgttctcagctctgtcatttaggcatattgccttgggaaaggaacttaagtgttcacaaagtctcagatttgtgatccgtaaaatccagatgatgataataccttcatcatggttgaaatgagacaatgcatgtaaagcacttagtgagaagcctgtcatggagacatggccgttaaatgttagctattttcactaccattgtggattttatccttctacagaactagtaataataatcataatagcactagcaatctagtaattatagtagtgatcactcattattgaaatgggctccccctgttggccaggcagtgttgggacttttatctgattgttctctaaatttcacaacaatttttttaaaaaaatcagtattattaataaatattattcagtactatttataaagcaggtgagactcagagtgtaagtaatggttctaacatctcatagctagacatagaggagctgggatttaaattcagacatgtatgattccaaacagttcttcatactgttctgtagaaaaatctatgtgtagccctaggaaatgatgtgactttatataagcaagagcaagtggggaagtgttggggttggagatgtttcactggttgggttgcctgggattggatgctatgccaaaaaagaacctaagagtgaaagaggaagatagcacctgtggagtaagccaggctgccaatgccaaggaacccatggtccaaagaccaaaccaaacaagtactcagccccaaagacaaggcaattataggcaagcagtactcaatgagaaaaccaaccagaacagaaccagagacagccagtgggagcttactcagcctgtgttcattcccgtcggggttgggagtggtataggaaaatgtcgtcgtttatttatgtatttttatgttattttggagacagggtctcgctctgtcacccaggctggagtgcactggcactattacagctcactgtaaacttgaactcttgggctcaaacgatcctccttccttggcccccaaagctctggggttacaggcatgaggcaccacgctgggcccagttcgagagtattcataacattggttgggcaacttgctttggaaggctgtactatcttgctttatctgagatattcaagtgcttttaagatctttatcaactccaattagacttcaacagcatttggcagctttctacatatatcgtgtttcaaggttgttgatatctcttgtttttatctatggtagagctttcacttcccttttacattctacttgttgctttagggtgatctccaccaggaaaggaatcaataattcgctttatgtacccagtagaaaactgtatgtttctaaaaaccttctaaaggaagcagctactgaaaaacaacataataaaaggaaaatgaattgtgaaaatacatatgtaaagggataaattgtatatgtaaaggaaagtaaaagccaggagcctattttacattatacagccttataatttggaaatttcttcatagcatcattataatgtgaggcagtatggagtatgattaagggcatggatttttaaatcagcaacctctgtttaagtcctacctgttactttagcaaatcagttgtcttaaccctttatgtaaaaaagggaatatcagggggatttatcttacaaaattgttttaaggattaagtgagctactctatgcaaagcacatttcaagtccctgtcttagtcagttagagctgtcataacaaaataccataaactgggtagttcgaactatagaaatttgtttacttagagttttggaagctgaggaatacaagatcaaggtgccacctgacttcctttctggtgagggctctcatgctgacttgcagacagatgcctttttgccgtgtcctcacatggctgagacagtgcgagctctttggtatctccttttatgaagacagtatcatgtcagacaaaggctctaccccatggcctcatttaaccttaattacttccttactttagatataggcatactgggggtcaggatagcaacatctgaattttaggtgaacacagttaagttcacagcagttcacagccatccccattacatgttttaattttatttgtttatttctttttcgagaaagggtctcactctgtcacccaggcttatagtgcagtggcatgatcataactcactgcagcctcaacctcctgggctcaaacgatcctcctgcctcagcctactgagtagctgagaccacaggtgtgcgctaccatgcctggctactttcttcactttttatagagatagggtctcaccatgttgccccagctgaccattttttaatataccaattaaattcaccaaacatatacttgtttaaatttaactcaaagatataacttctattaacatttcttaatatattgtaattgagataaagcacagcattatcatatatcattattgtatattatatgatatatctaatattattatattattattatgggatttatcttacaagattgttttaaggattaagtgagatactctatgtaaagcacattgcgtagtccctgtcttagtcagctagagctgtcataacaaaatactgtaaactgggtagttcatagatgtatgattatgtatgtgtcatgtatcatgaaaatgatttacattttctcccattctctgtggcccatggcattttaaggacttcataaaaattggctataattattatttttattggagaagagatacactccatatgcctcttctattaaattttaccattttagtagttttaaaatgtataaatcagttctttttagcatatacacaattttgtgaaactatcaccactatccacttccagaatatttccattacccccaaaaagaaaccccttaccacctagtagccctttccaacaccttctttccctcatatactgggaactactagtctgctttgtgtgtctatgtatttgcctattctggacatttcttatgaatggaattatgcaatatgtgaccttctgtatctgcttctttcacttctcataatattttcaagattcatctctattgtcacatgtatccttttcatggatgaataatattccactgtattgatctatgacatttgtttatccattcatcagtcaatggacatttgagctatttctaccttttggctattattaataatactgctatgaacacttgtgtaaaagtgtttatgcagacctgtgttttcaattctcttgggtattgtgcaaaaaagagttaacaggcctgactgctgcgctttgaaaagcctggtttaaaaggttggccctttattggcatgtggaaacctggatttcagtagggtgcccactaccctaactggtaagagtggctcactgttcctaaattgtgcaaataatatggttttttatgaacaccttatttccttctgggaatctggaattttggtatatgtcaagcagaggctgcctacatgaccagcccccagtgaaaaccccgggtactagtctttaataagtgcccttggctggcgttttcacacgtgttttcataattcattgctgttttatgtgcatctcctgggagaagacttgggaatcttgcctctgatttcctccagtcttcactccatgtgtttcttccctttgctgatttttctctgtatccttttacattatgatctaataagtcataactgtgagtatgaatatatgccaagtcctgtgaatcctcctagtaaaacatcaaacctggggttggtttcggggactcctaacacaagtatatacctagggatgaaatttctggatcaactttttgagcaactgcaaactgttggccatagtatctacactattttacattaccactagcaacatttgagccttctgacttcatgtaatcactccaatacttgccatcatttattttctgggtttttttgttttggtatttggtatgtatttctttaatagccagtctactgggtatgaagtgctatctcatttgatttgcatgtctctaatatctaataatgtggagcatcttttcatgtgtttattgaccatttatacatctctgtttggagaagtgtttattcaagtcctttacctattttttaaattgagttgttttatcattattgagttgtaagattcttttcatatgttgaatactagattattattagatacatgattcacaaatattttctcccattctgtgcattttaagcacttcaaaaaatttggctataattattatttttaatcaatgatccttcaaatcactaggcttttctcattgaccaaaatagcctcatatatattatcaccatatgcatacattttcttggttttttttttaaccctttaacgtttgctatgttgatagcatactgatttctctatgttgggaaagtatatttcacacattttggtaattatctatggaatatttataaatatctctattatgtgctggatattttgcccagagtagaagcatattaactgacaagggccaactcctgaattcccttttagaaaatgttaacaactgctcagatcctacttcaggatgcttttcgtgtcaagatcccaaaggtttgataaagaatggttggttttcatttgagatagtcattacccagacaaggttggttatatttcacttaatgtttttatggcttctaacacaaccagtagttttctatttatttcctgggagtagggaaggatagttgtgttgcttgaagtgtattttttattatttttgctattaaatgagaacaacaaaaattcactgtaattattaactttctttcattttcacatttatttctgtaatttctcaagtccctgaaataccctgaagagacttatctagttaaatagttaatattttgttgtgaaagttttactataagccaaacattttactttttgtttttaaagtaaatgtagacatatgcacattcatatgcaaaatgatgggcccaaattggatcagggatttttaacctgaaatccatagattatcttcagggaggtgtctgaagcccctgaaattgcatgtacatattaactccccccatctacttatcaatgtgttctctaatttaaaaaatgattaagaactactggactagataagtcttagatctgtccagattaggttatttttaaaaattcagttactaaccatcagcttgtcagtgaagatatgttcaatgaaggaagggagggaccttgtcaatcttttttcactattgtatcctctacatgtgaaacacggtacgtactcagaaaacatttgttgaattagtcaatgaatgaatgattaaggaacaatttctccatagagtgacctaacattagaacattagaaacaaggttcataaggacaagacttcacttttttttttttttttagacagagtctcactctgtcgcccaggctggaatgcagtgtcatgatctcggctcactgcaacctcgcctcctgggttcaagtgattcttctgcctcagcctcccaagtagctgggactgcaggaatgcaccaccatgcccagctgattttttagcagagacaggatttcaccatgttggtcaggctgatctcgaatttctgacctcaggtgatccacctgcctcggcctcccacagtgctgggattacaggcattgagtgaccacgcccagctaatttttatatttttagtagagacggggtttcaccatgttggccaggctggtctcaaacccctgacctcaggcgatccgcctgcttgggcctcccaaagtgctaggattacaggcgtgagccaccacgctgggccaagacttcacttttgaaatagaatgaaaagttaatttacatagaaaattcaaaaattgactttcttggtgggctaagcctcagctagttctctcaaagaccttccagaagaaccaggttctattataaacaatagttgacaagtaatcaggatatgtagtgttcagccctagttctgctatataccagcttattctacattccaagttgttttgtttgttcattaactcattcattaaggatggatcagatatccacagtgtggcagaaagaatgataaaagctggggaacaatgaccacattaactcaagtgtctatcttctaagagcttgcaagcaatagacaagtaagtaaagtattataagtgtgactagggtaagtatcatggtgtacagaatgctttgaaagcagaaggaaaggccatttcattatagggaattttttgttgcctgacaaaaatacagatatttcctattttttgctacattacactttgcttctttttgatgtcaatgagatagagatgccatgacatcaaaagccagaaaccaaccaaagggatttatactgcttttataccctattaaatgcaggtagacattacctaccctctttccagccctgtctgaaggtggctttcttttatagtctaaactattctgagcctgaacattgagcataactcgttcagagacctggggaagattaaaggtaggttttctgggacttacacctgaatttttatgtacccaactgagccatcagttttgggaaagagagggcaaaggtggaaagatgtgcttgctcactttattactctcctagaggcaaaaaatttgtgtccatggtgatttatgttcaaaaagatcttattccatctagaccacagaaagtcacatgtgtcttcctatctattagataaacactaaacagaaacaagggtgcattctccttcctatgccaaacacttcccctcccccagcattatagactttaaagaatttaaagacattttgtgtttacatacttgtgtaagaattattaggtgccagaaactaatctcagcactttaaatatattaagggatttaacacttacatcctataaactgggctccatttcacaaggaagttgaggcacaaagtctaagtaactcactcaatgttgcatagtggtagagctgagattttgaacccaggcactgtggttttgacccctatagcttatagacattagcatattctttttttgtttgtttgtttgttttgagacagagtcttgctctgttgaccaggctggagtgcagtggcatgatctcggctcactgcaacctccacctcccaggttcagcaattctcgtgtctcagcctcccgagcagctgggattacaggcatgtgccaccacacctggctaatttttatatttttagtagagatgagggttcaccatgttggccagactggtctccaactcctgacctcaggtgatccacccacctcagcctccccaaatgctgggattacagacgtgagccaccacgcccagccaagataattggtttagaatcagttttctaattctatctgcatcccttaagagagagaaaaagaaacaaatcatggtagtggcagagtaaccaaggcttttggggcctcactgtatttgtcattaagttaggatgcagaaataatacctgccttagcttatacagtgtgggttggggaactctgccatgaacatggaagtattaagcactgacacatgatatactgatgccactgctgctatttcatgtccggcattgctcttcctgcatatggtactgaaggcacacctactgctgtgtgcatatgtgagtgtgagtgtatgtgtgtgtgagagagagagagaatttgtttgttgcaaacacactaagcaccctcttactgctacagggctctgtcagttactgctgtttttgcctgtagtgcttatcagtgatagcctcagggtttgcctgctcacctccttcaagtcttggatcagatatccttttctcagaaaggacttcactgtcaactctatttgctatggtctgaaagttttgtccccattaagttcatatgttgaaatcctaaccctgaaggttgggcctttgggaagggattaagtcatgagggcagagcccccatgaatgagattagcacccatgtaagagaagccccagagagctgcctttcccctttgctatgtgaggacacagcaaatgggtgccctctatgaaccagaaagtgggcttcaccagacaccaaatctgccagcacctcgtgcttggacatctcagcctccagaactgtaagcaataaatttctgttgttatgaagttacccagtttatgttattttgttaaagcaacctgaacagactaagacgctatttaaaattgcagtgttcttcctagattctctattccctttcttgatatacttaacttcacaatacgaatgacctttcaacaagctatgtaaattacttaatctgcttcccacagcctagaatgtgagctccttggacagtgtgtttacttctctctgtctatcctcagtgtgaatagtctagtacatagtgggtactcagtaaatacttgttgaatgaatgaaagatgttaatccattatcccctgtcagttacttcttacttagttgacatgtttctcaagcaagcagatgcttttgcaataaaggtagagaaggtcacagtcatccaccttctctgtggctagaggtgtatgggaagggatttgaggatcatttgatagcgaaatgaagaggacaggtggatgacttattcaaaagacccaacaactcaatggacgtgctttttacctcatcttaagaaagctaagaaaacgtttttttcctctcttttgataagcctgtgaattcaagtcaatggcattttttctgctgccatttatcctttcacagaaagggtttttgctttgtgtttgcccaaatcagtgtgcatgccactttaccttatgacaaaatgacatagaaaaggcagaatgcccaataattggtgcaaattttatgcttgtcattttgaaaggttataaatcccctcttttataatgttttctatagaggatactttaggacagaatatcccttctgtacatcaatatgctgctaattccaaaaaagaacaactttgtaatttgaaagaattggtaacaagtgtggcatatgatgaatcacatttatccattctgctgtctattgaagggaaatggactttcacttgtttccttctaaaccaaagtttcaagacataaatattgacaaaatagattatctctcttcctaagggatgattccatcattctttcccactatatttctaggtaaaagtggaccagttttactgttatccaaacaataaatgggaggaaacttcaggtactatgaaaaacatttcatttttaattggaaaatcaagattctggtgagagctccatcactgcgtatctgtgtgactttggatacaccacctaatctttgcaaacctttgtttactcgcctcaaaaagtggggtttgataaaaatctgaactcactcacatttaatatgccattttactcacagccttagtccatttgtgctgctatcacaaaatacctgagactatattatgcataaagaacagaaatttatttctcactattctggagactggagagtctaaaatcaaagtaccggcaggtttggtgtctggtgagggctgctctgtgcttccaaggtggcaccctgttattgcgtcctccagaggggatgaaggctgtgtcttcacacggtggaagggacaaaaaggcaagagggttgaatgctgtttgaagcctcttttatgaaggccttaatcccattcatgagggaggagtcctcatgaccttatcactctcctaagggccttacctctaaatactgttgcgttgaggattaagtttcaacataaattttgaagggggcacacacattcaaaccatagtgctcagcgtaccagaatctcatgtgttacttggtgctggtaatcatagagagcagttgccgtagtgtatcataatgccagtaagtacttggctctgatcttagaagaaaccaagttcagtccctgttctgcagcctcttataacggtggcctgtctccaggcctctcttttccatcattaaatgaggaagagcatagctcttgtctgtgggttatatgaaccagcccccaataaccatttttactttgtagagagcctaaccttattatgtactcagtaaatgatggttattattgtcattattttacatggctctaaagaggatacataggggttatcttttgaggaagggagagtcagagttgatttgtagttttgtaaacactcttttttcaaagctgagcaaatctctgcctaagttgaatgattatggctttgtttatccttctctgacaggactttctagtttcagtcagtgggtaatgtagaacatatgtctggtttggatttcccgacaaactttcaattaaaataccaatgtcccaccaggaagaaccgtatctggagccccttacctgccataaactttatctacattgtgttctcattcccaacttcactgtagacatcatgatagccctatctcctaagaaacaatgtgaaaaataattaaaatagtttcacaccagaaagaaaagcacaccaaactcaaatttagtggacctgttagaaatatgttctccaagttttgcttgagtagctttcagattactccctttcacgcttcctagtatatatattgacgcattcactatgtgccaaattacaaacctgaaacatttagagaaagacagaagtagggtactttagctgccaaagagacaggtgcaaaggctcatgaatattagttgaggagctgcggtgcatataacatgaaagtactgcctgcaggcattctgtgattgggcagtttaatgtcagtgggaaacggagggtgtcactggggagttaaaaacaacagcagttcaccccagaagggcttaaaacagatagtctccaggaaactgtgaaattatgactgaacgtagaaagggcaacctctccactttggtcgtacttttgtttagatgagaaggaggatggtttggctcttgggagcgttggagagatagctggggaaagaaacggtggtttctcccagtcccacaaaaggttggacaactctggattatagtactcttaatacatgacaactaaagcgtcagaagccaaagcagatcttctagatcatttatacctcctattaaacagaaaaatatatccctatgagcatggataatgggagacactgttcattcagagcataaaagagaggcatttccagcatttgatttcagagccatgcaagtgctcttttttccttggttatcagctctggcagccacctggtgcttaaaacagcctgatgtggttgctgaaattacccttctatgccctccttaaatagtggctcatgattgtagatcacctgcatctgtaacccagggtgcaacattctaatgcatatgcctgcaccccgtccccaaatctatgtaatcagaaagtttgggaaaggccacggaatcctatagtcctcatttttaactggctctctgggagattctttatgcgtagaaagaatacacaaatgcatattgaaggcattagcactgcttttggttaacggtcttttcaaaaggccaccattaaagtgtatgaattccagcttgaatctaacagtctccagaatgacttagattgtagttatatatatttttttacaacaagaaactgtcctgtagtggggaagggcctggacaacacacatgatggagttttccatatgcatccagaaataccagaaggggtacagttcaaggaagcagatttttagggagtagttgatcccggtggtgttcaggttgaagtacagacacaaaaatgaacagtaagtccacagagagaaggcttttgcctgccacattgctgaagaccagtcttacttgtatgtattcacacacacacaagtacatttggagaaatgtcaaaaagaaataagaatagaacgaagaccaatgacatgaagaaataactcactgaataaattggtgtgtacctttctatgcatatagtgttgatcaggagtttcttaggtacagctgataacaactgcaactcagatttgcttaaatgaaggcaatcattagctctcatatctgagaatcttagggataaagcttgcttgggacggaacttgttccagagctgaaacgatgccatcagaactcagtctgtccctatcctttaattttgctcttttctgttttggcttcattctctttttaggttctctctctctatgtgggagtctttggaagctccaggcttccttctgtaagcaattctagactacaaaagggttttttccttgtagttttatgaaaagtcctgcaatggagtctcattagccaggctttggtcacccatgcatgggaaccaatttaaccaagaaaatggaatattaattggtcaggccaattgataatgtataaataagtattaataacttatcaatgctaagcagtgtcatctgctactcctgacctgtgcagaggattttagtctatccaaaccacttgagttgaaagagtaggagggttggttcaccaaagaaagagtagaatgctcttacctaatgaggagcagtggatactgaggcaaaaatcacagatgtctactacatagttatgccagtagggaagcaccattgagtgaattagtgaccctgatatctcatttacatttctctagctaaagccaatcaattttatacatgtatgtttctatgcttttattctcatgagtaaacagtaatgcacctaaatataaatcggaaagtttgctgcagtggagcgctgggttgttagggtagtacactactctgtgtgatattgtaatggtggatccatgtcctaatacatttgccaggaccacagcatgtgcaatacgtgatggaccctgatgtgaactgtgggctttagttaatatgcatgcattcatattggcttatcgattgtaacaaatacagcacaggaatgcaagatgttaacaatacgggaaactgtgtggagaaggagtgtaggcaaactctctgtgctctgctccatttttctgtaaacctcaaactgctctgaaaaaataaagttctattaattaaaaagatgaagttagctataactattattagtcctctctagagtaaacattccatgagggcaggacaatgtctgctttgcacacggttatgtcgcctccatgtaatattggaattggaatccaatctagtcccagaaactcggatcagaagccatttgggtcagaaatgtttgagaatttaaaatgtttgtaattttagaagagaaatatagcccacaaaacatgcccagtgttacataatagcatccccagctgagtctgggtcagcactgcataatcaaacgcatttctaattctgcagcaaagcatatgaatattcacattgagtctataaatagtctcccatcagttcccatcagttcaggtcagtttttgcctccaaatgagttacaaagtatttgcatttgttggaaatgcttctttcttgtcataactagggcttggcgtcagtatcacccaattacttatttttaaaagagtcattaatccattgttcctggaatgtgtcaaggtttaagatcagggtcagagtaggatacattgatacagccccacggctgttcttttccacgcctaaaaatcctcgagcaatgcacaatttttccccaaggagagaccctttttagctcccagcacttccccgtcctaccactgtttctaagatctggcattacaaacgattagggcttcattatgtgtgggacaaatgcatgatggcggcagcattattttgttaacaagagaacaaagaaatcgtctgagaagagttcacttctcatttggatttttttcactttgtgccttcagacatacaccagctgtcggtagacttctctgtttcttgctgtttaaaatgctcatttgaggggttaaaagaaggaaggcggaagcaatgacaaatgaaagtaatgtttatcctttaagcaggcatgtctgtctcctctaatatttgctttgcctctgctctattcagctgaacaaccaaatagaatacttattcaatagaaacgctgtgtgttggccagtttttcaagtaggcacttgggtaaggcctttgaacatgccttgctgtctgtcttataaatactaacaacactaaattgtattagtaatgatagtgtgacagctgtccaatcatcatttctacaatcagtgattgaattttaaaggaattcttgcactcaggaaaatcactcttacagtatttcatttgtttgtgaatttccttaggttattgcccatacgttttatgagtaatttagatccacagagatgctgctgatcttacagttttttagccaaaatgcatttccctaatcattaggaagcctggaggagaaggttcacagccagcaggacacagtgtgccctacgtgtgcccttcttggaacatgctggtggtggaaagagtaatggttcttcccattgggttcccccttggtgtgagtggtgagggagaaagtgaaatatgagcaggacactgagagcacacccaacaacccagcttagcagaacttccccttccttttccctggtgactttgttctgcaatctgataaagcaacacgttcccactgattacacacacggagcatttactctcttgattggtcaagggctctgcaggatataggcaaagccactctggtttgcaccaggttacttctgtgcatgcataacgcaaaaagctacctaccctccagatgtgacccaggtacaactcatatctaaacccatgcagtcttccctggctggtattctaagcttctattcaagcccttgtgttccccattaggtgtcctagagtttacttcccaagtgaaaattgttgctcttgaagtgtttctacccaagaccaggtgtttaatcaaatagcccatttgatgtcatgggaagattgactgtatatcacagtgctgggttcttggctgttatggcagcacttcatacctgccattaggattaagggcttaaacaagtttcaggtgcaacacctgggaacaccacagcaatgacaagtagacttgaacctggaatttgtagttttctaagatgaaatcataatattgcatttttgttctttcccaacagagtcagttgaatttgcaacagatggaaatacttccagcaaaagaaaagggtgctgttctaagggtcatgcggcgaaatgtggccttcatcccacggagtagccgcagagtgatctagcacatagaacagaactctgcagggtagtttttcttcactgggatcctaacctgtttagaaatgaaagtggccgggcgcggtggctcacgcctgtaatcctagcactttgggaggccaaggcgggcggatcacgaggtcaggagattgagaccatcccggctaacacaaaattaacaaaaaattagccgggcgtggtggcaggcgcctgtatttccagctactcgggaggctaagcaggagaatcgctcaaacctgggaggtggaggttgcagtgagccgagatcgtgccactgctctccagcctgggcaacagagtgagactccatctcaaaaaaaaaaaaaaaaaaaagaagagaaaagaaaaatgaaagttgtctgtgctcaattcataactagttttaaaactttagaatgcataggccaggagcagtggctcatgcctgtaatcccggcactttgggatgcgaaggcaggcggatcacaaggtcaggagttcgagaccggcctgaccaacatgctgaaaccccgtctctactaaaaacaaaaaaaattagccaggtgtgttggcacgcgcctgtaataccagctactaagaaggctgaggcaggagaatcgcttgaacctgggaggcggaggttgcagtgagcagagatcaagccactgtactccagcctgagtgacagagggagaccccatctcaaaaaataaaataaaataaactttagaatgcataaagatcaagagatgcttgctcaaatgctgttttctgagtcctgataattagaatccagtaggtctgggagggactcaagaatctacctgttaacaagcactcttagctaaggtcatagaggttcagtatcccttatctaaaatgcttgagactggaggtgtttcagactttggttttttgtggggggtggcagtggattttggaatatttgcatatatataatgagatatcctcaggatgacacccaagtctaaacatgaaaatcattaatgtttcatatataccttatacctatagcctgaaggtgatttatacaatgttttaaataattttgtgcatgaaacaaagtttatactttgaatcatctagcacaggtgtcactatctcatgttggcactcaaaaagttttggattttggaacatttcagattttggatttttggatgagggatgctcacctgtttcagccgggaggtttcttgacacactttgagaaataattattttaggtatagtttgacttacctttttactatgttgctttctatgaaatgtttattttgagattagatctactgcctgacttggtccagctcctaggattgttcacagatgccctgtaaaaataaaaataaaaaccaaaaaactacatttagcatcagtggaattttcctagctccacccaccctctagcttcctgctttatgcgtgttatctttttttgacctttcccttggaatccagattttgttctgtacttgctcctgtgggcttgatatttgggcatctgcctcacttccttgagttaaccatcacctgagattcaggcttatttttctctgctcagcctcagcccagccccatccattcagattctcttgcccagcctcgcttccagcagcctgagtagtatcctgcttgcctgggagggaagttcaggaaaatgtggaagtgggccaaattaattaaaagaaaaaaaaatagagatcattgatgttccaatacagcaaataaattaagtgacacccggctgcggagaggtgctttattactctttttcttagagggtttttttttttaagtcaaaaaatattttgtttccattacagatgtggtcatttttattctgtaacctaggaaaataatattaaataatattttctaatggaaaattctatgattctgtgcatctctttcagtaatccaaaaatttcagattagcccagagacactatgttttacttctgggacccttgtttctggtcatgaaatctgtgcttttttctgataatccaaagatttcccactccttgttgaagcatgaaagcagattttttcagcctagtcttctcccttccctttatgaagatgggtttatccatcctaattcaagataattaccgtggtatggaactttgcagaacactggtagtctgatagaagttagcctagtgactgattggcaggtacctagttaccaaggagaaacaaactcaggaaatcatgaaatcatgatgtaacagtattggtgcctgcactagatcctccaagctgtgtgtcagatcaatggtctggaatccacaagactgtaggtgagctcttggcaatcttactgctcactccctcattcctcattcctcctcttaacatgatttttaggaattcctagaagggtggaaaatcattgccttcccctcctctaataatgtgagcccatgcccctaatttctccaaggcagatgatgccctggggcgactctcacccttttggggacccaagtgtaaaaacattaatcccaacatcctgtcactcaaataagaagacattcattacttataaataaatggtagtggttacagtataaatgctatgtatacaaatgaagacaaactataactataggtcagtggactattgtgatctctaaggatgcctgctctttgtcaattcagtgcagtgcttgttggggagggtggtgtctcacaattagcttctggagttcaactacaagtgttctaagaaagagttagtttatgtcagtcctaggccttgacacattcatgtgagtcagttttataactttctgttcctggatgcttccctctcaactattagtccaggcaggcatgtgctaaaattacctctctaaatcttatcaagcaaagatttgttggttagactttgcccccaaaaaaatgtgtctaggagtgggtctaaaaccggtgttggccgatgttctgttcttaggaaatggagagccaggaatagaaggatctgtgttagtagttctcaaacttcagtgtgcagaagaatcacccagagagctaggttaaagggcagattaatgcaccccagattcttctggcgtagtcagtctggactgaggtttgataaaacaagcatggcatgataataatgcaggtggtctacagtctaactcggagacgcattgtattattaaatcttgtcctctgtcatttgctgcgatgctctttacctctttagactgaaaatcacagccactcttctggttacatagaacaacttactgtgataaaaaaaaaaaaaagatgaactttatcttctaggctttgaaaacggtaaatgcagtcttttgtatgtgccttcaagacacttgaaagtcactttgtggctgccacacagagatagaacaaacttagggatgcctctccccctgtttcatctcagaacgcctctctcaggactctttgtctcacccaggcacctcaaggttttggtgaaataaagcagctcttttttctcaaaaacattgttaaccctggtccgaaggtttaaaagctaggatatctgggttttttttaataccttgatagctaaactttctaaaatttctcccttcatctttgtgagcccaaatagctcgtgcacaaaagcctgtggatttccttcgatgagaactgaaatactattccctttatgctaatgttaattttcaggcagtgagcttggttaactatgagaaaataaaaactttagatggaatgcattatttatagtgaatgcaaagcatcattattatcaattcttgttacaaaatacacagaaaaaatatctttttgttatttaaatattgcatggctacattgagaaacagtacagatgttaatccacagtctctcagctgcatcctgagtaatcattattacgttttattcttatgtggaataactagtaatagactctatatttctgtatgaaattcaaatcagggaacaccaatgaattgagatgattgatattatatatacacacacataattttggaattggggacaacaatggaaatatttctctcttagagaaaatccaccaaacttgttgctttattagtgatcttgacgaataacatgtttcatttacctagatgtgccaaaaatcacttaattctttaccattgaagtgagctcacatttgaccagtacttaaatatgttttgaaaatatctgtgtaattgttaaaaatctgaaattgaaatgtaaatatctggattttgaaatatccaactttaaacacaaattttttttttaaagtgcatgtttgtgtttttttttttttttttttgagacagagtctcacagcatcgcctgggctggagttcagtggtgtgatctcggttcactggagactccgcctcccaggttcaagagattctcctgcttcagcctcccgagtggctgggattacaggcacacgccaccatgcccggctaatttttttgaatttttagtagtgatggggtttcactatgttggccaggctggtctcaaatgcctgacctcatgatccacccacctcggcctcccaaagtgctgggattacaggtgtgagccaccgcgcctggccatgtctgcgtacttttattccatgattttattttgtgtgctttcataaatcttctcttttttggttgttttaactttttattgatgtggtattttataaatggagtaaggagagacagtggtagtggtgatatgattcatgacatctttgaatgcaaattaaatgtgtaggtacatgtgtgtttatgggaaaatattcctggctgttttccctgtctttgttttttgttgttttgttttgttttgagatagcgtcttggtttgttatccaagctggagcctgctggcaatgatcatggctcactgcagccttgatccccccagatcaagccatcctcccacctcagcttcctgagtagctgggactagaggcgcatgccaccaagcccagctaattttttaatttttggtagagatagggtctccctgtgttgctcaggtttgtcttgaacccctgggctcaagcaatcctccacgcctcagcctcccagagtgctgggattccaggcttgagccacgatgcccagcctgttttcccatttttaactgataaagaatcactggcctagtctaatcttattgatttatagatgaaacacttcaggcatgtagagactaggtgattttcctgaggtcctggagttagtatttgacccaaggcattgaaactcagtccatggtctttctgaatcctcacccatctctttctcacaacaagatcgtgggccgtcctcagtccccagtaataagatagaattctgtttggtcattttgtcttcttaacttttcttctatttcaaccttagcatgaagtgctttttttttttttttgtctgagttaaatgttaaatgccttagaaattaccttaccaggcttcacctagatccccaaaccaactttattcttttttctcagcactgatgcacctgaatgaattcagtctcatcctatcacctatcaacaaaaggctggttatgaagtttttccaggatagcagttgcaattcttgcccttcaaaataatcacatataaggggactgccagttgcagggtgatatttaatataactttacatcatagcctctggtgattctatcttaaaactcatcaggcagtgcctaagtaagctaattgaatacattaaaaattgaaaaaaatacttcaaagtaaagcagattcttattgatcaccgtgtgttatatataccactgtacttggtaccacaagagatacaaaaataggtaagatacagtcatgctttcaaagagcttataatccaaacaagggaaaataaagtgtactctatgttaggtgcacttagtagaaaaagataagcgtcttgggaaatatagttttaaaattatattaaagaaaaaggttgagggtctagcagagtcttccaggaaaaagaatttgaacttgattttgaaaaacgaaaatcacttccatgggcgtaagcggcgagatgcattttgaacaatatttattgtgtgcatagtctagaagcatgtgtactcgacactgccacttaaggtatggtttgtggatcattccagtctttgaactttgttactgctccgtgacaaaataagtctcatgcatccagtttctcttattgagagaaagcacttagaaatgcatggctgtttaacatggcttcaccatccaagcacataatcagtggactcaaatcattgcacctgttatagaccagtttgggcgttactgagtcatctgtggtacaggctatgtgacatttatgcaaggtagaccatatatggcttcataagacgttgggaaaacaaagaacctagtccttcgctgcagataatgtgagaataaagactgtaggttgttctttatttgcatacatagtcattttgaggaagtgttgtgtatattagcaatacggagctgttactcattattgacttatttacagtatcgtccttgcttctttctaattttatcatctcattacagcacagaaaaaaatgttagctttatgacactagacagccatccacaatgacagtagcacaaaagggatacgggaagcacaaagtaaaggggtaggctaaagacaagcagaacaatacatagaagagagaaagggagacgtcaagcagcctgcgcctggaagttgttagtaaaattagtgaccaatgtgaaataagagggcttatattttcacttcatcataatccacagaagattaaccttcaatgggaaattttcttctagaagctgaaacacagcctgttgtgccttactattttttgttaatttctttctattattttccttatgttgttgtttcctgttgttgttcctatttggaagggattcttcattttggacattttctcttctcatttcagatgattccacactgcatggcccgatttttattcaagaaccaagtcctgtaatgttccctttggattctgaggagaaaaaagtgaagctcaattgtgaagttaaaggaaatccaaaacctcatatcaggtttgttgatgtaaaagcatgtgtttccatgcatatagtttctgttattaaaatcaacaaatacttatacaatgctggttacataaagagcttttatttatttattttattttattttattttatatatttatatttttgggaccgagttttgctcttgttgcccaggctggagtgtaatggtgtgatctcagctcaccacaacctccgcctcccaggttcaagcgattctcctgcctcagcctcccgagtagctggaattacaggcatgcaccaccacgcccggctaattttgcatttttagtaaagacagggtttctctgtgttggtcaggctggtcttgaactcccaacctcaggtgatccacctgcttcagcctcccaaagtgctgggattacaggcgtgagccaccacacccggaccaagagcttttatttatttatttatttatttatttatttatttatttagagacggagtctcgctctgtcaggagtgcagtgtgcgaccactgctcactgcaacctctgcctcccaggttcaagtgattctcctgcctcagcctcctgagtagctaggattacagatgtgtgccaccatgcccagctaatctttgtatttttagcagagacaggatttcatcatgttgaccaggctgatcttgaattcctgacctcaagagatctgctagcctgagccttctaaagtgctgggattacaagcatgagccactgtgcccagccatatttttatttttcgagacagggtctccctctgtcacccaggctgaagtggattggctcagtcttggctcactacaacctccccctcccgggttaaagggactctggcacctcagcctcctgagtagctgggattataggtttgcaccaccatgcccagctaattttggtattttcagtagagatggggtttcaccatgttggccaaactggtctcgtattcctgacctcaagtgatctgcccgcctcggcctcccaaagtgctgggattacaggcatgaaccaccacgcccagcccgtaaagagcttttagacaggcatcatagatatcctgaaagtctaaggagatgattgtttcctgaaaagctaagtacccaacctctgtttttcgtagtgctgggaattaaatatcctgattgactttctctttgaaaacattaacaattcataaccacatatatttaacttaataaacatattttaaactatatcagtaaactggcaggaaagtaagaaatgtcagaagtctacaagtaagtgggtttggaaccgaaagaagtaagctgaacaataaagacagttttcatgttaataaactacaagtatgaattgagctttggttttcatggcttcagagaacagaggtcacaagacaaagcctagacaacccacaggagaatccaacatgagaacatctcccagaataaacctgggatacaagggctacatctttacagtaaatgtgaacaagaaataagcttgacttccaaagagactcaaaagcacaggtaattgtgtctttcaaacattaaaccttagtggttctagtagcagatgaaatacaaccgaaaagaatttgtaaactgcaagataggtctgaagaaatcctccagaggcagcagaaagagacaaagggaagcaaaatactttaaaaagaaagagagaaaaaatgtctactcaggattccagaagaagcatcaagaaagactgaggcagaagcaatatttaaagagaaggctaagaattttccaaactaattgaaactttcaagccgtagctataggaagcccaatgcacttcaagcagtacaaataaaaatgaagccacatctaaaatagtgaaatggtagaacaccgagtcaaacagattatcataaaagtaaccaaacttgtaatacagatgacattcaaagagatcacaaactggcagctgacttctcaatagcaacaaaaaatcaggagacagaagataaaatattcagtacagtgagagaaactgtcaaatgtatggatagcctaaatacttcttttaaagcaaaacaaaataactacatttttaggcagacggcaaccaaaatctgactccagcagaccctcactaaaggaaattttaaaagacatacttgaggtggaagagaaatgattccagatagaagagctgagctacaagaataaataagtaaagcaaatggtaaatgttagtaattccacaaaaaaatttattgcacagaacaataaaaataataaaaagaatactgtcttgtgaagataaaaagaaaagttaaaattcatgacaacattagaaacaaatttttaaaagatgtactagacaatggattgtctatatggttaaagaaataaaattggaaccctactgcgcagcatacacaaaaatcaattccgagtgtatagaagacctaaatgggaaatttgcaatacttttaaaagcagatgggtttacatatttatgactttggggaaggaagagattttctaaatatgacagaaaaaatacaacttataaaagaaaatatttaactgtattaatattgaaaacttatgttcaatagaatatactgaaataaacaaaattacaagctgtaaacttgaagaagatttttaagtatatttgttatgggtaagggattcatatccagactatttaaagaatttccacaaacagaatgtaaaaaacaacctagtggaaacattagctaaacactttaacaagtatttctaggaaaatgaaaaccaaaaattcagtaaacataaaaagattgtcaatatcattagtgaacagaaatatataattaaaactacaacgacatactctttcaaaactaccagattgacaaatttagaaaactgacaatctgttggtgaagatgaagagcaaacagaacccttgattgaacactgctggtagcaatttaaattggtaaaagccattaaaaaaaaaaacactccctagtaaagctaaaggtgcacgtactctatgatccagtgtatatgattatgttcatagtatattcacaaatacacataacctggtatgttcgtacaaggtaacctcatacagtagtaaaaatgaatgaatgacagctgcaacaaatgggtagatctcaagaacataattttgagtaaaccagttcacagccaaatgcatagtatgtaatttcatattcataaaatttgaaagtggttgagatggagtggttgttcaaggtatagaggaagtaacagaggaagcaaaactttacccctcctctcttaggatttttcagctaagcctgagaattaaattaacataaagcagatcaaaaggagaaaaacatatttatttaatacaagttttacatggcaaggaagccttcataagaaaatgaaaacccagagatgcagttatcgttgcacatttatttactgaattggacaaagagtagtaaattgtgaaaaagtaactaagttatgtggggagctagaagaaaatattttaacaaggtctggacagagttttctctgtctcaacttcctgtccttgatggaaagaacgttactttccttctaatatagaaaggacatctttggcatggggattttatccttgctttttagaaaaagaatgaaggtgaaagtggtcgtcttgtacctgctgttttccaagtacctttttttttcccccaagtacctttaactcaaaatagtcaatataggcagggcacagtggctcacgcctgtaatcccaacactttgggaggctgaggcaggaggatggcttgaggccaggagtttgagaccaacctgggcaacatagcaagacccccatctctacaaaaataatttaaaaattagttggccatgggggtgcacacctgtagtctcagctagtcaggaggctgaggtgggaagatcgcttgagtctaggagttccaggctgcagtgagctatgattgcaccactacattccatcatgggtgacagagcaggaaccggtctctaaataaataaataaataaaagtcagtatgccagagcagcatatttttgggtggcatgctctgaactccttcaaatgataacatacatgataaaattataaagaatatcacgggaatggaaaagccaaaattaaagattataattaaccattaagaaggagtggtataatcaaagtagatacagcagacttctaaagtaataatatcacttttaaacacagatcttcattggcttatgatttttataacttacatacatcttataaatattatgcctctattcaaatttgataatgaaaaactttaacaactactatctaatattatgtaaaaaacaaatatatatgtcatagtttaggagagactggagtcatcaggtagggttctcagaagaaatgggatatgaactgagataagtaattttcaaataggcagagggtaaaggacattgtattcaagttaaaggacggcagtattagtatagtggatattattttagaatttactttacatgctcatttatccatttgttcatttatcaaacatattcattattcatccttcaaacctcaccagtgtttttcaaacagaattccagggcacatggaattggcttaaagatcaccagagaaagaaaataacagaattttcatccaagattcagcctttgcagctctactttgaactagcccatatattaggattctgaaaaatacgtcatatagacaaagtatttaaaccactctattaagcagctgcaatgtaccagtcagcatgctaggtctgagtattcaaagattaatcaactctacaacatgcttactagtactgttaatttgaggactgcctagatgtggacgtagttggagtagaatgatgtaactacaagtaaaggatgaccaagttctaggtattctggaggaaagaaagtctaattcaggatggcgaaggtagatgtcactgaagtcttcacagaaaaggagatattttaatatatttggagggtgaatggttctttcatcacatggataaggaaaagaagtgcattccagaaagtaagaaaacaacaactctctaatggaccatataattagggtgaacatgtaatttatcatctgaggtcactttttaaagcagaaggccgctgttcataattattctaggacagcaggtgtaaaccaagcacttgtcttgggcaagccagaatgaatagttactctccctagaatatattaaacccaaggctaaatcaaagatttttaaatactttgtgtagtaaagaatgcaggaagcaacggctgttaggtacacacatgatgagttaactggtccttgtttgccttgcgtagccaagtgtaaggtcagatgttagccgtaaatgaaaacacattttgcagcagaatttggcaagtgctgctttgttttcccccaaactgtgacctttaattaacattgcttttgtaacactgtgtttctagatataggagtttgccttgttatttaaagcaagcagtgaaacagaaacctattatgtttttagatttccaggaaacactgagaacaaaactttttaatcaaatgcactagcaatttattgcagtatacttcttgcctttatgcctttggcagtgtctctgtaacataatagcagactggtacctgggagctaaagcattcctcttgttgaaagaaagagcaagacaaagaatggagagatcaagtattttcagacacctttctgcctgaactttttcagtcttcaggctgaatttgagggggaagaacaagtagaagaaattccgaagtgagtctccatggggatcttcagcactaggttctctcctcagacaccgcaactgacctctcttctttgtgtttattccctcaactgagccttctcttttcattgtttcctgcccctcaattttgaaaggattgacccagacccagaaaaatttaagaagttttaacttgtgccaacttcccttatattaaacttccctaaggacatatgacattacttaatgcactcagcatccctttccagatagaagaaatgttcactcacttggtcggagtacttttgctgaggtttgtattcaactgagttggcagaaaacaaattccaagtcataaatgccctgaccttcccttagtgccaagttgacaccatcaacaaagaaagaggattttgctacagcgaatcctatagataccctcccagcaaagccacagcattttaccctccagagtgtcacagcatcggtgtttggttgtgcacaaccccactctctggagagagtggagtcgtggttcctcaaatgattcagaaatcagcttatgagactcacaaatttctcttgtcccttgggaaaatctctattggctccaaatgagcattgcctctatattaccaacacttaaaagattcctcacacattgaaagtaaattgtgaaattttcaagcgtgtttcagtatacagtgagataagaaattcagtgcaatccacattcaattggaatgaacagtgactgcattgcaataaaacttggtatagcgctttgtaatagagactcaactgcatttcggagaaagcactttattttctaaataatcccttttcgtttgctatttgtatgtaaaagcaggcgataaagtagattaatggactttctgcacagcattttagttgagatgactagtgtaggaaaacctacagaggagctctcattatgcccacaaccacttttctaaaaagactcacatggccccactcctaaattccacactctgcttgcagctcacattatgttgcgatttcctttttgagttcttagatttgtcatattaaattgctctactatcatttgaagtaagagttatggtcaagacgtgatcagctgactcaaaaaaaaaatgtctagggcagacagtcagttctagagattcatgtgcacatagagctgctagaatataacctggctgttctgtctttattatactttcttgtctgtgtcagagcacagagaattactgtggagactaaaaacattgtcagtttctaatcccaatcttcttatatacaaacacataaagaggtacctcatgtttctatttcatgctcctggtctacctttcttacctctcttgtttctaaattgttacatttcaaagacatgaataaacatgtgttgctatgtggtagtgtgctggaatgcttcataaattgtggatgttcaaagctaaaatatccagcaaagaagtgaaatatttagttaattaaattcaaccagcatttatggagcacaatgagagtgttagattttagatggctaaagtgagaatacaaaagtgatttaggtaaattatctacagtaaaagcagcattcctacataaaggagcatggacaattccgtaggagattggacaaagctttggttaatttttgttgtttttgttttgagatgaggtctcgctctgttgcccaagctggagtgcagttgcagtggtgtgaccttggctcgctgcagcctcaatctcccaggttcaagtggtcctcccacctcagcctcctgagtagctgggactacaagcatgcatgcaccaccacacctggctaaattttgtattttttgtggaggcagcgttgtgccatgttgcccaagctattctcaaattcctgggctcaagagacctgcctgcttcagcctcccgaagtgccgagattacaggcgtgagccaccgtgcttaatcatctttggttaattttgactagaaatactaaggaagacttcattgaaaggggtgtcactgcaaaatggctttgaagtgggacagaggtcttgacaaaaagaagggattacccttctgtatatttgcttttgttgataccagacatccaaaatcttgaaactaactcacgtacatttttttcatgtaaatccttttacattatgtacagacaaccacagtacccaagaatgttataagatgatacacagtgaatgtgcatgtgcacacacacaaatatttaaatggtgatttttactatttaaaggagataaggttaatggctctcattccttactctcattatggatttggatcagttttgtttgtgctgctgtatctcttaatttttaacattctggtgtgaatgctgctgtgatactcttggtaattcacaaactcctactatgctattttcgttagttaatattctgtgtaagagttgtgggggtaaacgaatcggatagtgactgagttatattagtgcaaacgttctgaagtgtttaaatgacttctgaaaggagatttggtcaagagaagctctcactctttggaatggtattggttgtaaaatgaaataaaaacaaaaacataggtcttattaccaaaacttcgctgttaaaatgtgtgggtcccactaaacctgctttactgggctaaatactctagtcacatacataggtgatccaggtagataaacagaaggacaaaaaacaaaaaacctgtctttgccccgataacctaatagcctaatctgcagtttgctgggatggttgattgatgtttgtgtgccggtggtgaaggagctcttcaaagtgatccacggttaaagcaggtttggtccccacagcagctcaagatcaatagttcctctgctttgcagccagccattgcagtcatattaaggaccaaatcaaagcaactctgctgcaatttcatcagatacttagcaatctacctggaaatagtatatgctgtcatctgtatagacctatttaaagaatgattgcaaactagaaggacttttactgaggagccccatttgaagaaagctgcacaggtgctatgagaaatctgtggcccgccttcaaaacagtgaagtgtttgtagcatcataagtagtcagaagaacattttaatgatattaaaaaaattttaatatcattgtttactttaaaagacatgctctttccatataagcacttaagatgtcaccattgctgggtagagcatttctaacttcttaatcatgctttttacaaaagtcacaaatgatttttcatgctatttatagtttttatatattttagacaattcagaaatattgattaatatgacaagactttatctactggcatttttatactataggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttgtaagtagcaattatacaatgctgcaaatgttgctttcagtttgtgtaccattataccaataagcttttatagcagtttcattttagagactagattttaattggttacatgatcatctttactctttttcacattttggaaacaattttatttgtaggataaactgtaaatctaagtgagaagatgtattcttctacttcgataaggattgagatagttgattgtatgataatttgattatatgatgctttctttatatacaaataaattcacacactgagattgacacatgtataaatttatgtaaacaacaaatttgacacccacacacacccacacacacacattttaaatagaatgtgtataagcaagcaattgaacaaattttacacacacacacacacacacacacattttaaatagaatgtgtataagcgagcaattgagctgccagtaatttagtagagtcaataagagaaatactttaacgataaaggtgagagttggaaaaaaactcagtagtcaattaatcctacaattctctaattgtttcctatttcacagagttgaaaaaatttaaagcaactgtaataatgacaaaaacatggagacaaagtgttatccacctttgatatttccagcttaaaatgtttaaaaaaacaaataaccgtgtcttaagaccaccatttaacaaaagtccatgaatatatgaaagaaagtggaatttagaaatcacaatttgaaaataaaatccataggcaagagcaattagcatacatttgggtatagccacctttgaggattgaggttcagctacatttttaagggtttatgtatttgcatgtgattatatatttccttgtgtgaaatcccaactcatatagcagtgaattttggcattagccaaaggtttcataaagtctgctggcagtaacactgtagaatattctcattaacaaaatcctctccaggaactcaacatccaatatacctaatatccagttcctaatctattaatgccatttggtggcatttttataagttgggaaatgaattttctaagtattatgtatatgcgagattccaggattattctgttagtgaatgtctcttgagatagtcttctaaatattcgtaggtgtttagaataataggagaataatatgtgtgattgaatgtaacagaaccaaagtgtttctttctcttggtttaatacaagtcttgtatctatattgattttttagtaatgacaaatcttgctaaattaatttttggaaataaccataggatcatgtactctcagagtacgggaaaatctcattatttagtaaatcttgtaattctttgaattttggatgtcatagtgtaggaaatgtttaacacagtataacaccaaaaaaaaaaaaatggagatggaaatattgtatctgggccagcgcggtggctcacgcctgtaatcccagcattttgggaggccgaggcgggcggatcacgaggtcaggagatcgagaccatcctggctaacacgatgaaaccgcgtctctactaaaaatacaaaaaattagccgggcgcagtggcaggtgcctgtagtcccagctgctcgggaggctgaggcaggagaatggcgggaacccgggaggcggagcttgcagtgagccgagatggcgccactggactccagcctgggcgacagagcgagactccgtctaaaaaaaaaaataaaaataaaaataaaaaataaaatactatacccaaacttctttattgacagcttacatttaaaaaaaaaaaattaccagctcttaagattatccttttgtaaaagaccgggcattttactaccaaaacatcagaaagatagaatctcatattcaaggacagtcatttacatagaatagtttaaccaaaacaaaaaacaaaacaaaacaaacaaacaaacaaaaagctctaccactcagttcgtggtgggttgacctgaggacctaccaggaaatggaatccactttgctcattccacttcatgtgtgatgtaggcattcctcccaccctcaaaatccttggctgatcatcatttggtttgaaaaattctagtgacagaaagttcaccaattcatcacgaggcaccctggcccacagcagactgctctacttgttcaaaaatacaaaaacaaacttgacatctctttcttaaaattgagccaaatatctcaatttctatcacattcactcccaattcttactttaaagatgctggttactcttcaaatatgtgaagatatgatcatgtcccttgtcccataattcttttcttcccaattaattaatccacagccatcttcttcacaacacactcaattatgttaattcatctattgcagccttatggaaatgcacagaattccatatatgtgtcttaacttttgcaaaggacactggggacagtagtatctcatgatgtgaacttttttcagttaatgaagctgacaataatatttatttaatcttcatttttaagtaccagccccagattgcaactttattttaaacatataatcatgtaaaatctgagaaagtatttcttataaattcctattcatccagtgctacccaaccacgttgttttattaacctaaattcagaatattgtatttacccctaataaattcatgttctgagtagtgaccctttgttccatcatatctgaaattgctttaagtcttttttttcaatcagacataatgattgttctcctagtttagtgtcagcagaaaatttgataagcatatctccattcaaataattgatataacatgttgaccaggacagggcagcatgtcactagagaatttccactaaaatgaaattaaacctttaatttaatattatttggacactcttgttcaaccagctacaaatttagccaaatatactataatcgaactccaatttcatccacgtgtttttaaagtagtgagaatctttgctaaagccttgctaaaatcaacatgtattgtttctgcaacatccagtcctacctgctccgtctgcatcgtcttgagcctttccttaaccatttatcctaaaactgccagagtaatcttttaaaaaatgtaaattagatcattccgcttccctgctttatgccttctactgtacttagaataaatctcaaactcattaccatggtctcattttaatttctcaaaaatgacaaactattttttgcaacaggatcttgatacttttgttccctctgcctgatcagcttttctcatgatctttcacacagctgacttcttatgatcctcacttctcaatttaggtatgacctcctgagagaaagtttccgtgtcaccctgtctaacataacaagcaatttccatcatttctcctcctctctgctgaccttcctccagccctctacttttacataacagtatcttctatttcacttaccagaattttttgtttttttattttttgagactgagtcttgctccgtcgccctagctggagtgcagtggtgcgacctcagctcactgcaacctccacctcctgggttcaagctattctgcctcagcctccaaagtagctgggattacaggctcacaccaccatgcccagataagttttttttttttttttgtatttttagtagagatggggtttcaccatgttggccaggctggtttcgaactcctgatctcaagtgatccacccgcctcagcctcccaacaaggtgagattacactttgcccagctcatttaccagaatttaatacaatctagaatgattgtgtatttacttttttctcatttattatttcactcctatggcagaacgtatattttaagagaactgagactatcttgtccatccttttatttcctagccatttatatgtttgaataaaggaattcctgtgttacgtgcctgttcagtaacacaacaaagaaaatatatgtataaagttaatttgagggtgatgtatttttatatacccaaacccaccctttctattcttgtaattttctggagtttatctttttgatcattgatccatagtttctagatgtttttccctatcttttgtaaattaaaagaaaatcaaaagacattgcctatattcagaattcactttcaattgattaggataaaatccttttcttcagtgaattaataaaagtgaggcaagacagtgacatcttttgaatgttactagtttctttgactccacgtattgtcatactcattgaaggaaaaaaaaatgttgctttttggccacacttactgcactataccatgcaagtgagaatatttcttcctctttaatcatacaattttatggttaaaaaagacattaaaggtctcctggcctgtatctttttaaaaatgaaattgaagattagagtaacggaattactcattgttaatacatagttaagaagctacagagccaaggaaaggcagtcttcagctcccagtttcatgcatgctggccctactttgctttagatttactctaatttatgagaaaaacaaccttcactttatttaccatgttacaattttcaaatctcatttacatactttctataattttattcagaagatagtcttataaggtagacattatttctattgattattaaaaatgttttcatgctgcttttgtgcacagaacttagtcatgtcttgtattagcatttagcatttttaagttgaattaattcacataagcaaaatttatagctaactagagatgagaccactaagaacttgctcttcctcccactttttaaagtcaatatatttaaaatagaaatccttctttgattaaataaggatagcataatttaagtcccccttgatgagatatggataagcatacattattgtaatgtaattgggagcacattttgtttttcagtctctctgcagcattaagccatcagcaatcactcccctcactgtcacttagcctactaccataccctttctaccttttagcccttctatttcacctagggctacaaatatgattgactagatcctctgtgcctggcacttaataaacttgaaataatggttgctgaatgaataggaattagacattaaagtcatcatgccatgtgtggggcataaggaatgagttgaaccactgagtcaagcacgttctgatggtcctttggagtgaattggaggtgagagcaagcattctcaccttgaggttgatacagaagacagttgacatcttaattccttataagtgtttctattggtgtggcaggcgttggcccacattaaaaggatgcttatggccaggcgcgatggctcatgcctataattccagccctttgggaggccgaggcgagtggatcacgaggtcaggagattgagaccatcctggctaacatggtgaaaccccatctctactaaaaaaatacaaaaaaaaaaattagccaggcatggtggcgggcacctgtagtcccagctactcgggaggctgaggcaggagaatggcttgaacctgggaggcagagcttgctgtgagccgagatcacaccagtgcactccagcctgggcgacagagagagactcagcgagactccgtctcaaaaaataaaaataaaaaaaataaagatgctcatgtatggaatgaatcaaacaagccctcaaagttcgcttttaccctggaaagtcagcctgagactacgcacagcttcatgaagtgtttcaaaggaaagctcctttgagcttaagcatacctccccaaccttcattcactctacactccctttcgtccaggagcaaaaccaagttgaatacttcaaaaagttcttccatagacgaataaatcagaagataaggcctaaagaggaggggatttcagttcgttatttgcacagcttaacgaaggggatgtttccagagcttgtgtctatacagaatgaagtgctatagctccatcaccctagctgcccacttttgcagcccagcatcccggtctaaatctgcttgaggatctttgtgcacagtcactcaacacagcaacttttctctgtcatataaacactgatatttattttaaaaaaataaatttcagtacacacccctacactcataaacaatacaaatcctcatttttttttaacttaggaatgtgggcttgagaagatgagatgttatattgactaagtttagagggaatcaaatgtcgttaattgttccatttcattctatgtgtcctgtgtctctagaactccagcttctcaataccactacacttcccttttaaggttgttagcaagattacattgtaaagcatatgtaaaatcccagaatcatttccaacataggaaagttatacaataactgcttctgtgtttttttgtctgttctctcttccattcccctttctgtccctccatgtcctgtctttttaaaataactatcacttacaaaaacttaattgactcatagtaactgcatgtatttatgggttacagtgtgatacttcaatacctgtatgcaatgtgtaaatgatcaaatcagagtaattagcatacgcatcacctcatgcaactaaactatcatttctttgtgttgggaacatgcaaaattctctcttctgaaaattagagtaaattggttttttgttgttttttgtttgtgtgtttgttgaggtggagtctcgctctgtcacccaggctgcagtgcagtggcacgatctcggctcactgcaacctccacctcccgggtccaagcgattttactgcctcagcctcccatgtagctgggaatacaggcgcccaccaccacgcccagctaatgtttctatttttatagagacagggtttcaccggcctcgaactcctgacctcaggtgatctgcccatctcggcctcccaaagtgctgggattacaggcgtgagccaccgtgcccagctgagtaaattgttcttaactgtagtcaccctgtggtactagagagcacaagaacttatccctcctatctagctgtaattttttgtctgttaaccagtctctccctatccttcttcctcccttccccacctctagttaccactcttctactgtctactctaattctgtcttactaaataagaccaacttatttagcttccacatacaattgagaatatgtggcattcgtctttctttgcttggcttatttcagttagcataatgtcctccagattcatccacggtgccataaatgacaggatttcattctttttatggctgaataatattccattatgtatgtatacttcattttcttgatccattcatccattgatgggcacttaggttgattccatattttggctattgtcaatagtgctgcaataaatatgaaagtgccaatatatctttgatatattgatttcctttcttttgaatatatacccagttgtggaattgctggatcacatgaataactaccattgtatacctaagtatagttgataagagcacaagccctggagtcagactccttggattcaaattcagcttctataatttcgtgagcttgaacaaggtacttttttctgccccaggttgtttacctcctttgttgtgaggatcaaatccattaataattgttaaactcctagatcattgtttagcaaatagtcagggcataataaatgttataatgtgaatactctatgttggatattatactaagcactttggaagcattattccatttagttctcaacacaacccaatgaagcacagatattacttttattttataggtgaagaacatgaaaattaatgatgtgaaataactttcaccaaggatacagcagtgggagaagggaccagcataggaacctggtcacctgagtcttgagcagatgcctgttatatggcattttacatgcatggcttcccttatgctgtgaaaaactacactttaccagtgaaatttatgttcaatccgtagatttgggtggttggtgaaatgtttcctttgtacacaaacttgaattttttgttgcattaacaatctttgatatagtaagtacatccatcatatatttgcttttgtttttaattttttagttgtaggtattcttgatgccatcatactgttgatttactgtgaacatctaaaagcataatgttacatgcaatgactatacataaatttgtggactctaattttaatataattggtttcaggttttataatgagaataattaataacaatatttctgctctaaaagttaagatgcagatttccaatttattgcaagtaggctgtaaagcattttgaatattgatattttatggtgaataactggttggtaaactgtttatccccaagcagtaaatgaaatatttgtataagcttcttactcccatatcatttctcccctacatgtgagaaagatgaactttaaatgtagattattatgaagagcttcccagagaataatcttaatatctaatgactccagattttagcctgtcaaactgattactttataaacattgtttggggccttcatcctggaattttcactttcttgtagtagttcagatctgcaaagcaaaagacttaagctactcatcatctcaggctgtagatgactgtaagtcatacataagtacttccaaattgctaatggtaaaattaaatctttgaacaaaatctggctacctgcctgctgtagggaaactggcattatcatggtcatgggcaaggtggtattattctggaggaagcaaatgggtgatatctatgcttacctctatggatacctcacttaagatgaggaaagtaactagactaatacaccattcatgccctacatctctaccctctgagcatgtgttaaggggaagggcatagaagatgaaaagtatttttaaaaaatggaaaaatggagatgttaagtgaaaggagtgcttacgtacaaaagccacttcattttggccttcctgtgacttcaagcaagcaatctatgaataaagtaactcttctgctgttgcggaatgaagtgaaaaaaaaaaaaagaaaagaaaaaattttaaaaagagagtaatgtaacacaataaatcactccattctgaggttaatttaagttagccttatcagttaagtggcaaacattttttatggtgaaaatatcaattgaataaacagcaactgattagatagtctcattgaaaaagatctttcttatgactactacagcgagccttaatctgagttctctttaactggggcacactctgacaactgtaatgatggtggtggtagtggtagtggtggtggtgatagaaaactttattaaactgagaatgtattgtattctcactgggaattttggcaacctgatttttgagcccagatccttgcttctattcacggtaattttcaaatgttcattgcttttaatatctaataactagcttatccttcatagccaatgagtaaaatgtgcagtcgatcagaacagtagctgggagtttgatacacggctaaactcataactggcctgactactttttaatttggaaagctgcttaaacaggcaaactttttttctgagcgataaaatgtggatggatgactatttagatgaataatctgtgaatatttagatcaactgaaatgtaatcaactttagaaacatttgggtatcaaaagtaaaaatatttttcaatggaaggctttgatcttcaataaaagggtaaatacttttattggaataggtagaagaagtcaaacccaaacttgctgagtttctgaaataatgatagtttctgccactgagtatagtactagacagaaagacattaatggtgataatgggtgtctattgaaaatttcacaaggtaaatcttaggagctattaaagtacagatgctagttaattgtagctattattaatagtttattatgtatactttcttttggtcatcccacagtccagtttggggactgataaaaagcagtttgtgacataagacaatcaatgaagtatagagattgctttaaattcaagaaggttctgagagtatgatatatatatgaaaattggcgaatgaaacctgatggggatccaagcaagattcatcagacttttaaaaaacatgaaggctaaaagagaacaattaatattttgtatcaccataaaaaaaccaaggtactaaaatatcactcctttttgtttcgttgttatgagtaattcagtcaacaaatattaaaataattctgatcatttttaagtttaatttttaggcactgaaggtcaacattcatgtgttgccattcggggaaaagggagaccactttctgaatgattgaaaatgtcacaattgctctaattatatcaatatccttttcttcaagaattttcatttgagaggttatggtgctgtagtacatatattttcacttgtggttaagtcagaatctaattgactaactatagtgatttgaatggtacctgctatagactgaatatttatatctccaaaatgcctatgttgaaatcctaaccccagtgtgatcatatgaggaggtggggcctttggtggtgattaggtcatgagggatctgcccttgtaaatgggatcagtgcccttataaaagtgattcctaagagctcccttgctccttctgccatgtgagtgagaaggtggcagtcagtgaaacaggaagagagccctcacaaggcaagaaatctgctagcaccttgatcttggacttcccagcctccagaactgtgagaaatacatttctgttaagtttcccagtctattgtgttatagcagccctaacagactaaaactgtaactctcaaaaaatgtgtctacctggaaactgtgaaagtgaccttatttggaaaaacggtctttccagatgtaattaagtagatgacatcttccaaaatcacccagatggaccataaattcaatatcaagtgtcctcataagagagtgaggagaaaacacaggagagaaagagactatgttaccatggaggcagagattggaatgatccagcaggggaaaccagtgattgctgaaagccaccagaagctagaagaagcagggaaagattctctcctagagccttcgaaggtgcccagcactgctgacaacttgatttcgggtatctagcttccagaactgcgagagaataaattttttttttaagccattcaatctgtggtaacttgtttgcagtggttccaggaaacaaacaggccaacatatgcacaattctttttcatttctttcctgaccactttgatcaattttttaaaaaaatctttgaatgagatcaaaatcaggtgcttttgtaacttaactgtattagggtgaaaagtattaaagaaatggcctctatcaaatgtaggattatctgtgcaagttttgtctcacactatgcattttcccctggagagcataacagagttttgaactttataaagtatgatttgaccagataatgaaatggggactgcaaaaaattcaaagggtaacctttccctttcccgggtatgtttttacctctcacttggaacagacctctgcaggccttctctgaaataggcagaattggccctttctccatagggcaatgatttgaagtgatgcggagtagtttgttggccctgagtcccgctctctggacttcttccgttttctaggtcattttccctgaattcgacctctttgtctggcactctaaagccctagaaactggctattatcacgtttagagtgtctgacctacctgtggctgtaaccgttccactgtggtctctcaagcgatgttatcgttgatgttatgacatttctagccccagaaagtccctgtgctagtgagggccagcttccgtcctcttcgcagtcagcacctttcccggagtaggctctaacataaacaaggcatttgccttctagctgtcatgtattttatgcaccatgctagctagtttttacttcatgtctataatatatattcactttagagaaaaaagtatgcgttagggttcagaggttaaatctcaaattcaagggcatcatgaaaagatgtgtgtgtttcccaagaactaaattattctgttacatatttcaccaaagattaaattccaaactagccactaaactctcagtagatggcactgaaggtaatttatccctgaaatatgtatttagggtacacactaattatgattagagtattaatttgctcctaaatacttgcattgttatctgtcattagcatttcagatttgttcatttgttcatagcctctacttttttttcccctcaaattgaatgcagtctagtgtggtaggtaatctgttagctctacctcataaaatttagattaattatatcttaaaggcccttctttatatagtcctataagtaatgtatatgttgaggtgagggagtcaacaaatggcttttcttatttctaagcgcaatgactactttcttctcaaatgctgaataatgccgaataaatgctgttaagtgataatgaatgttgataagtgctgaataaatatttgtggaataaatgaagctgaatgaaccaatgaaggaatataagagaaaccgaaatgtcttggcctttaccagcctatgaggttatatttcctcttgaatattctatttccttaaacaaagaaatagaatattctattaggaagagccctccaataaaggtgcatattccatatagtctttctcattcacctagaaaaaaactcattatgaaggtgttgcctcttactttcaacaccatacttttttttttttttttttgagacggagtctccctctgtctgctggcgtgcagtggcgggatctcggctcacctctgcctcccaggatcaaactattcgcctacctcagcttcctgagtagctgggattacaggcgcacatcaccacacgcagctgatttttgtatttttagtagagacggggtttcaccgtgttggcctggctggtcacaaactccagacctcaagtgatccacctgcctcggcctcctaaggtgctggaattacaggcgggagccaccttgcacctagccagtaccatacttttttttagtaacatctttgttaagataccataccatacaattcattcatttaaggtgtacaattcagtgatgtttagtttattcacgaagttgtacaactgtcaccactgtctaatttcagaacattttcatccccctaaagataaaacctgtaaccgttaacagtcactttctgttccttccagacctgataaccactaatctactgtctctgtggattttcctattctggacatttcatgtaaatgaaatcgtaatatatgtggccttttataacttgtttcagttatgttagcaaggttcatctgtgtcgtagtgtgtattagtacttcatttcttttttcttttttttgagatggagttttgctcttgttgcccaggctggattgcaatggtgcgatctcagctcactgcaacctctgcctcccggcttcaagctattctcctgcctcagcctcctgagtagctgggattacaggtgcctgccaccacgcccggctaatttttgtattttcagtagagacagggtttcaccatgttggtcttgaactcctgacctcaggtgatctgcccgcctcggcctcccaaagtgctgggattacagcgtgagccaccatgcctagccagtacttcatttatttttaggtctaaagaatatgcagttatatggatgtaactccattatatttacccattcatcagttgatggacgcttgggttctttttactttttagctattatgaataatgctgctatgaacattcatatacaggtttttttgcggacacatgtattttcatttctcttgggtatattcctaggagtggagtagctagtggagttactgtatgtttaacatacagtaactgggcaacagaggagactctgtctcaaaaaaaaaaaaagtatgtttaacattttgagcaactgtcaaattattttccaaattggctgtatcattttacagtcctaccaactgtatgtaaggcttataatttctccacatcctcactagcacttgctattgttggcttttttagttttagtcaacctactgagtgtgatgtgatgtctcatgtggtttagatttgcatttcccacatggctaatgatgttgaacatattcccatatgtttattggctattgctacatctttggagacacttctattcaaatcctttgctcatttttaatcctttgcccagttatcttttcattgttgaattataatatttctttgtatattcctcatacaagcgccttgtcaaatatacgatttgtaaatattttctctatttactgggttgtattttcattttcttgatggtgtcctttgaagcacagaagttttaattttggtaaaatctaatttatttttttcttttgttgcatgtgctcttgttgtcacatcaaagaaaccattgcctaatccaaggtgacaaaaacttactcctatgttttcttctaagagtttcatggtcttagctgttaaatttagctctatcacccattttgagttaatttttgtatacgttgaagtattcgttcaaaagaatgatttttttttcagattctttcttttgcacgttatcggttttaatatcatctgttgaaaagatggttctttctctcatgaatggtctggacacttttgccgaaaatcagttgacctcaaatgtaagggtttatttcagggccctcaatttcattccattgatttatatgtctgtccctaggccagtaccacactgtgttgactgctgtagctttgcagtaagttttgaaattgggaggcagctgttaatagtaccttaagatcaaagaaatatgatgctcacatcgcatgagctatggactctatcctacattccctgcaagcaaaacatactgcctttggatatgtaatataaaattcaatatcaataaattctgggctgtctgatttaggtaaccacacatttggagccctgacaatctaatccactgtttccccaaatttgaggtagaactcatttgtccttactccttttctcagggtctcagttctattgtctgcaaacaaccactcaaacaagaatgttagtgatttcctaacagcagtcactattttacaggccaggcacaatctaaatccatagagaagaaatatttttctctaggcatgaaaatcctaggagaactgttaaataagcaagaggaccatttaacattgtccagctgggctccatttctaacttttccaagaccagtggagaggtaattgctgtatatttgcataactaaaaggcccaccttgtactcgttttctaagaacaatggacactgacccaaggtttattttaaatgggcggtttttctatctctaccagagtactctgtaataaataatttctcctaaattttcttaggtctttcagtcttcctgttggccttgtacttgctattccctttatctaggaccacagaaaggctgtgaccttcagtaagtttctatacccctctgaattttgctgccttcatctattgaatggacataatgatagtatttgagaattatttaagttacatagtatccttcagagttgtgaggattaaatatgcctggtaagtgtaacctgtgtgtgtgtgtgtgtgtgtgtgtgtgtgtgtgtatttgaacaggttttcacctagtcacatgtagatgtacattaacatgtgaatgctctgatttcttatctcttttgtctgtgagtattctagtatttattatgctatatgataattacagggtatagttttgtctggctctctcactggtccacatacaccctgagaactgaattggatccatgtttttatattttacttggtattaaacattggtacatagtagatgttcagaggtttcaaacacagttggcagttgttctgtctaggatattagcttcattttactctaaccagccatttatcctacataaaattcaaggtcagtaatcacctgagatttctaagaagggattattattaattaattactgatgctgtcaagaacttgttaattctcctctatgtttgaataatcaagtacctttgggcaaatgtgctgtaaaaacttgagttatccatactcagtatggagatttcttttgtttatttttccttcttcccataaatatttaatgaataccaactggatagcaagcaatgcgttggacacagggaatgcatcaatgaactagacagatatgaagtctacatccagtagggaagacagacattgaacaagtaacctcaagtgtggtgaatgttaggaagattgaaggtcttgaaggaacgaagggcagaataagcagtagaaaagcgggaatgaagagctgacctaaaagtagtgtttgtatataaggtaatttttcaactttttaatttcaggaatacacgtgcaggtttgttacataggtaaacttgtgtcatgagggtttgttgtacagattatttcatagcccagatattaagcatagtacccattagttattttccttgatcctctccttcctcctaccctatgacctccgataggtcccagtatctgttgttcccttctatgtgtcgatgtgttctcatcatttagcttccacttataagtaagaacatgcagtgtttgattttctgttcctgcgttagtttgctaaggataatggctccatccgtgtctctgcaagggacatgatctcattgtgtatgtaccacattttctttatcagtctatcattgatgcgcttttaggttgattccgtgtctttgctattgtgaatagtactgcagtgaacatacacatgtgtgtgtctttataatagaatgatttatattcctttgggtatatacacagtaatgggaatgctgggtcgaatgacatttccatctttacatctttgagggatcgccacactgtcttccacaatgcttgaattaatttacactcccagcaatagtatataagtcttcatttttctctataaccttgccagcatctgttatttttttactttttaatatggccattctgactggtgtgaggtggtatctcattgtggttttgatttgcatttttctaatgatcagtgatgtcaagctttttttttttttttttttttttagactgagtctcgctgtgtcgcgcaggctggagtgcagtggctcgatctcagctctccacaagctccgcctcccgggttcatgccattctcccgcctcagcctcccaagtagctaggactacaggcacgtgccaccacgcccagctaattttgtttttgtatttttagtagagacggggtttcaccatgttagccaggatggtttcgatctcctgacctcgtgatccgcccacctcggcctcccaaagtgctgggattacaggcgtaagccaccacacgcagctgatgttgagcttttttatatgactgttggctgcatgtatgtcttcatttgaaaagtgtctattcatgtcttttgcccactttttaaagtggtggttttttcttgtaaatttaagttccttatagatgctagatattagaccttaatcagatacatagtttgcgaagactttctcccattctgtgtgttgtctctttactctgttgatagtttcttttgctgtgcagaagatcttcagtttaattaaatcccatttgtcaatttttgctttagttgcaattgcttttgttgtctttgtaatgaaatctttgcccgtgcctatgtcctgaatggtattgcccaggtgttgtcttccagaatttttatagttttgggttttatgtttaagtcttttatccttcagttaatttttgtgtatggtataagaaaggggtccactttcaatattctgcatatggctagccagttatcccggcaccatttattgaataaggaatcctttccccgttgtttggttttgtcaggtttgttgaaggtgagatcgttgcaggtgtgcagtcttatttctgggttctctattctgttccattggtctgtgtgtctgtttttgtaccaataccatgctgttttggttactgtgtccctatagtatagtttgaagttgggtagcatgatgcctccagctttgttattttgcttaggattgccttggctattcgggctttttttttttgttccatatgaattttaaaatagtattttagatgtttaaggagaggtataaagtggagggatacaaaaaaaagagcaagacatttcaagtgaggagaaaacatagactgtagcattcatccattcagatatttttctgagtgcctactctgtgctgggcagataaacaaagccagacccagtccctcatcttaactagttcatgttctagtatggaaggaaaatgttcatcaagtaatcacactagaaatatgtgatcaccaattgagacaaatgctaagaaaatggtagtggttctataatgtttgtgacaaaggaaattaacatagagagcattaagaaaaacttcactaagaaaatgattgtaactgagatctgaaggatcagtaaggattaaaaaggaaatgttttctagacagaaaatacagaatgtacaaaggtgctgtggtggcatagagcatggtattttcaagggattcgaagaagacctgcctgtgtggctggagggcacagagcaaggctgaatgcagcagagcagaaagtggtgggagggaggaagaaaagggaagagagtttgtcctgcattttagctcaagatttactgaggccactatgcttaagcgtgtcactttactgacttaagattaggaaaattctcatatggtcccattaagcatgctcagtgtcttgaagtctacatggtatgcaagacagtagctttctgtaagtctaatcatcagttcacacatcgtcaaccatccacctgtaacaataacaggagctaacacttctcacttgctttgcatgtaccagccattaaattaggaattctcttttttaatacttacctcaacactagacacctgtactcttgatgttcccattttacgaaggagagaactcagacataaaaaaattaaataacttgccaaacttcacacagctgggaagttgaagggctagggtatgattccaggtaatttgacttcagtacttgaattattaatcaccacactatactggctttctgatatttttactatggtgaaaatgcatttccgtcagagggaataatttgtttgagaaactcaaaactgagtttagaatttgatggtaataaaatacccagactcaatttctaaatgccgtactgtcaactaaactccacttgcatccataggtgaaaaggtgaagccgtgttttgttcttttgccagtaagtggcagtgctgagtgtagtacaaagagatagaggatagggtttcaatatcaccactcgtacttgtcgtcactgagtttctgcacggagatgaaaggatgagattgaagatgctaacgaagtcaggaaaagcccacttaaccgacagtgctagagaatggagctcaagtaatgctgatagtgctttttttccgggttaagaagacatttctcctggctccccttcctagagtatgtctcacatagttattttaagaattagaaaacatatgtgaagtacctggtctgtagtaaaaagggaaactatttgttttcctgggattagacagctaatcaaatactgctctactagcctgctgtgtatttttaattttgcttaataattttaaattattaatcatcaattaaatatgggatagctataattagatattttatatgccttagagtttttaatacctgtgaatagctgcacatataagttcctctgtcgtctttgtttctagttataaaacaggtgccctcagagagcatcctacagattgataaagcaagtgccacctggagaaacctaattccttattcaagaaatcttcatatgccaagaaatacatagcaagtaataacctaaaactgatcaaaataaatatttagtgactgtttcttcaatgatgacactgtacccacacacacagaaactaacattgttggtgctggaaaggacaaatcaccagctttgaaaatgtatcatgaacttagggatttgggcagtgggagaggaacagccttccagaatttgatcagctgtctatagcatttccaaatgaatcctactttatgatggcccttgagaaggcatccctcatcaccactctttccaaatcagagttaaagcccagagtcacaatagggcttcctttgggggtttggttcaaaatttaaatatcacctgtctctgccactctggttaatgtggccttcttcagtgactgcctctctcaatgccctgtggatttccttcacctttctcctgatcgcatctataattttatctataagtctaccttttgctttgtcagtcccactagaaactccaccagtgcttcacacacagtgttagatacattttttagataatcaggctagtccaaatgaccatcagttagtgagtggataaagaactgtggtatacatatatatgatggaataccactcaaccataaaaagagaatgagttagtggcattcgcagcaacctggatgagattggagacgattattctaagtgaagtcactcaggaatggaaaaccaaacatcgtatattttcactcataagtgggagctaagctatgaggacgcaaaggcataagaatgatacaatggaattttgggacgcggcggggaaaggtgggaagaggatgagggataaaaggctacaaattgggttcagcgtatactgcttgggtcatgggtgcaccaaaatctgacagatcaccagtaaagaacttactcatgtaaccaaataccccctgttcccccaaatcctatggaaataaaaaattaaaaattcaggagatgcaatagtagcagagcacaacgaaataacagaattaaggacacattcgccatatgtctcttttatattgagaacacagcaatattaatgaccagatgatgaccttcaacctaaactggaagttgtgtgacaaagtccatgttggtttggaagctaaaggtggaaagtgagattaaatactatagggcatggaatggtagtgacctgcaacttggagctgatgtaaggacttgataagtcaaagctcactaggatgcaatactagaaaaaatggtcttggtgtatcacatggattaagtgagattaaaagtagtttttttattagatctcaaaaaaaatataccaggctaataagtcattccatgtaaaagcgagggtgacaaagagaagctggtaagaaaggcaaccttgaaagtcttcacactttagagctaaacatgcaaaatatattcagagacaagatgaatgtgctttccttttggaagtgatattgatctggggagagggggagggtgatcttccaaagactttatttcttttgttatcaagtgattggtgtgagtgcacccttttgatcagaggtatgtagacatgcttgagtaacagctctctctctcctcttattgaactgctttttgtgattgatttttaaaataaacgaattgtttgcttcagctaatcagggactagttagtgtatcctgaaaaaggaagtttatataagtgctctttattacctttactgagtgagtgggcttttttgtttttgtttttgtttttgttttttaaattttcagttagttgccccattgacagacaatagagataacagtgagtccatggaatacctcatggtggaaaatgcacagccgattagaaaaatgttctacttgagcgtaccaaactaatcccaaacagtgaattctgatcccctttctgtctcagattttctctatgatcacgtcttacgataataagaagcaaagtctctaatggaagttcatcagtggcaacaactgtggctaacctgacaacccagcacctagtacagtgctcacaggcagctggtgttcaataaaagcttcttacatagctcaccttctcagtatttttgtgtttttttcctttaagtggttagaaggcagaatttaaaatattgtcacatagcagtgggcgtgtaaggtcatctgctgtttgccaaccaaatggtgaggctagaaaacatttgcatataaatgttacatttggttgaggcttttaaattacagaaatgtaggtaaaatggtcagagtggcagttagagatgaacaaatgttttacatctgtggagccttcatatttattgctttgagtgtcattgccatttcctgctggaaattaaacatcacaaatgtatccttcatttgaccaggtggcctcgatgcttctgaaatgaatggcgaatccggtaatataaattgtaatcacatcacaagcatcttcctcttaaccttggtaatgatgtgaaatagtgcattttaagcttgttttgaaggttaagcaggaaatcttatcttggataattaatatttcaacaaaaatcaatgtggctacagttagcaggtaggtaatctgactaattggctcaatattaaatttgttaactacaaattgtctttcagctgaaattgtattggtagaaacaaggaaattggtgaagtatttactagatttgtagcacagtcttgttcagcttgctgtagagagcttgtgatttaaacatggtggaccaatgggagctcattctccagccacctccacagcagtcctgatgacttcccctatctactttataatggcacttaggctgaggcaggaacatttcctcaggaaattgtcaccgtgtccacagaaagtgggttggtcctctgtgtctactgcttcactttctccttaataatccaagccagcactttatgccttgaaaaaaataactaatagttaagttgtctatatcgttttcctttttagaaagtactttcaaatctgttttatcttttagtctttacaaaggcctgtgaggtatgatttatcatcatcaccatccccatcttacacatgtagaatgtgaagctcagaaataggaagtgacttcctcaagttcgtgatcccattaagggacagatccgaggatcaaaacccagacttttgacttcaagtcttgaagtcttttcattgtaccatatcttcatttaaaatggggtccaccctgaagccaaagaaacacatccttactagtaggtatctgacatttgtcttattttgtgaaaaagatattttgggagcacaccttcaaatgctggttcccaaaacttacctatactgaaatttccaccagtctacgcaaatatgcactacattattaaaataaggtggccaggcacggtggctcacacgtgtaatcccagcactttgggaggccgaggcgggcagatcatgaggtcaggagttcaagaccagcctggccaatatggtgaaaccccatctctactaaaaatacaaaaacaattagtcgggcgtggtggcgcacacctgtagtcctagctatcctggtggctgaggcagaagaatcacttgaacccgggaggcagaggttgccatgagccgagattgtgccactgcactccagcctgggcaacagagtgagactctgtctcaaaaaaaaaaaaaacagaaacaaaacaaaaggcagtgtttagtcaattaaaggacagtttttctgttgatactatctttctgtaatttttcacgttgaaaagttctgtcttttatgtattgatgatggtagaaaattgtggtggtactggtggtaacttttagtatccatagttagaaacacctatgttggtttcacacacatctcatatttccccttaaaattctattgctccattaaatccaacactctgtaaaccaggattttaaaaaacaacatacagatgatagaatgggtggcaagtaaaaatgcttcttgcctgcagcacaggcccttagaaatcatcagcggagccaagggtctacaacaagcagatcaaaaatagcagcaagacaggctaactatcttcaggaatcaatgccagcctcttatggcattccctagaggccatctcttgggccttggcacctgtgctagtttcatggttagattagttatgtcctgttgctgaagaacaaggagtgacttctcttccatctctctctgtctctttttgtttgtttgtttgtttgttttttttttttgagacgaagtgtcactctcttgcccaagctggagtgcaatggcgtgatctcagctcactgcaacctccaactccctggttcaagcaattctactgcctcagcctcccgagtagctgggactacaggcacgcgtcatcatgcccggctaacgtttgtatttttagtagagacggggtttcactatgttggccaagctggtcttgaactcctgacctcgtgatccgcctgcctcagcctcccaaagtgctgggattacaggcgtgagccaccgtttccggccctcttccatctctttctatttagctttggaggaaaatgttagagatttaaaaccatttgctataaggcagtattgccttttgcacacacaaaccttccctggtgggggagggccaagggccctcagcttccttcatcccaagagaggaagtgcattgttataaaatccctcatcagtctggctctaccaaagaaaaggtatcataaaagcttcagatctctgcaaaatagtgtctctttttctacagatctttcttgcctggcttctacacatgcatcactgcactgacccgtaaggattaaggaaagtaaacaaacagaaactatccagggctagagataatcagtggaccaggctgagcaaaggaatgtaaatctaagtgtcatgtggctaagaactgctgtttgaaaagctgacgcagtgggaatagcaagagttgacaggcaatgcttagtgtatggtgagatgctcagtgtgagaccagttaccatttgaggcatagctcaggggctctgctaccaagcatggcagataactcccagaaacacacacaatgcatatccaggtgatagtaacaatgtgttttactgtgttttcctcattttttggtttgcttttctattaaaaattcagagaggggtgcatatgtgcttgaaaaatactgtttccccttcactggtagtgtctagcatccctgagtggtctgaaatggaaagagcaacatggagcctcatgcatcttcacagagatttgtttccaaagtcagcacttaaagcaaaatgactgtcattaaagttaccctcagaattctcttaagttggaagtatacatacccatgggagataggcatgccacctctcccccgaggatggaacagacaagtaattgtttctttggttgaaaagcaggtgaagaattaacttaagtttagagccacattgcatgagaagtgggtatctttaaatactctacaacatgggaaggtactctctctatgtgaagccagtgaaaattgaaactgaaaaataaaagagatttgggtccctcatctctaatgcagtgttggaaactgatcaagcaagccacatggtgggcagaattacccacactatttacatggctacctcttctctctcacacatatcactccaatatgtgacctctggcaaatcattctacctctctgagtctcagtttcattctctgtataatggggatgatgtgagtatcaatggccattttaaggaccaattgagacaaagtatgttgacatattttcttccaattatgtaaatgtcttatataaaataaggcatgctttattgaaagaagataatagaaaaagatctaaagaaaaaaatctgaaaggagtaaaaataaataaggaagatcttgtactttagtggaagagaaagacatacagtattaattccaggatattatgtggtaaatgaaaagacagcagtgtgcacagtatgtaatgaaaacatggagaagcaatatgtaatccgtcctggggtacacagtaggctccccaagagagacagtgactgagcagagtcttgacagatggttgatagttaaagaggccaagagagctggcagggtgtttcatgcgacaagaacagcaaagcctgaatcttcatggatatgcacgggacatggaaacattccatgtttcaaggttgtcaaatatgaactggagagtgggaggctacaaggggagagagagagagctaaggcggggagatgatggaggaccttgtttgacatggtaatgagctttagctaatcttttggtggctgacgatctcaaagggttttaagccagcagagtggtataaccaggtttgcattttagaacttgattactgtggcttcattttggaatgggcatttaaggcactaggataccagcatctggaaaaacaggaaggctttccaatatcgcaggcaagaaataataagagtctatcctaagacaaaggcagtgaaagtagaggaggcatatttgaaaaatacttttgtggtgaaatcgtcaaggttcgttggatggtttgggtgaaggtagggacggagactgagagtaaagagtacagaaagaaagaaaaaaaagatcatagaatgactttaaagtctaatgtcttggatggtggggtatcattgactaactttggaatcaggttagggttggagattaagaggtggcaaatttactttaagacataccaagttgtgtgatttatcacacaaacctggattcttatgagtgtgaaaagtgccactgtcaataattttgccaggacaataaatgtaaacctcaattatttcaggaaaactagaatgtaaagtcaccttatctgtaggatactcagcagttgaatatatgagaaatactacatcgatagggctgaaggtttacagtaaatagacatgaacataaagattagattttaaatcatgagaatgtataagatcatccaaaaaagagagaaaagcaaaggcaccttggtgaaaactagtgtttgaagggtaggtgaagttgaaagagccctcaaaagagactaagagggaggaagagaagagataggaatcaggagaggatagagagcagatattttcaggaagcagttgaaaatgtccagtacaacagagaaatcagataagataaggattgaaaaatgcccactggatctggcaacatggaattgacttttgccagagcggtttcatgggagatctgaggccagtatccagatagtggggttgtagagtaataagctttagttaatcttttggtggggggggttgcagagtaaatgggaagtcaagaagtagagaaagcaagggtatacctgaagaaggaaagagaaagagaagtgcacagctgaagggagtgtagagtcaaagaagtgttgctttatatattttttcaggttgacaaaatttttgtatattttaataggctgaaagagaaagtttaaagacacaaggtttattaataagttggtagtagtactgacttgttagatataaagtttgtacaagttttattcaatgatatattaacttatttaagttttgttttacattttgctctgataagtagtgggtagggaagggaatccaacattcttacggggtactttccataacacactgattgcagcatggagaacacttggcaactggaggaagacctcagaaaagtaatgcatgtaggattctagaggaagatgagactaggtgttcggttgggttcctgctcctgaatttgtgcagtaaggccgaaattccttactgtagacagatttccttgtctatggatggcaactatgtcaccttttctaaacaccctgtgggcattacaggcttagggggttaccaaactctggcactgagtaataatgaagccttcatctcaatgtagtagacttttttttttttttttgagacggagtctccctctgtctcccaggctggagtacagtggcatgatctggctcactgtaaactccgcctcccaggttcaagcaattcacctgcctcagtctcccaagtaactggaattataggcacccgccaccacatctggctaagttttatatttttagtacagacaggatttcaccctgttggccaggctggtctcgaactttggacctcaagtgatccacttgcctcaacctcccaaagtgctggcattacaggcataagccaccatgcccagcctcgatttagtagacttttgaccaagacaaatattagtccagaaaagatagatcaggccgggtgcagtggctcacacctgtagtcccagttacccgggaggctgaggcaagaggatagcttgaacctgggaggtggaggttgcagtgagccaagattgcaccactgcaccccagcctgagtgacagagcgagactccatctcaaaacaaaaacaaaaacaaaaaaaagaaaagatatgtcagctgcattacccccaccccaatctccatttcatctgccaatcttcttgccttctgatcaacctacctttcctaccgccattgttccttctctcttccacgtcacttttatgttatggtatctcacttatctcctctactttcaaagtaaccaaacacttttctttccttgtgtgcatcaaaatgaaggagggacccatttcctctacaaataattgactgaaaaataatggttgctcttcactccattagctcctgtgaactttagaaaacaattgatagcttatgtattttcagttttggaaaaccttcaagaatagctgaactttggaactgcatactagacctagcaggatgggacagcaaatagaataacactccttcaggctagtgagtgtctctttgttttcatttggaaagactgcaggaggatgactgttacagcagttttggaaccattgtgtaactgtatcccacgagacaacatcatttggtttcaagatgtttatttaatactgttttcttatttgtattaaccatcaacaacataaagcagatgcacattgaggctgtttacaaaatagcctgttgtacttgcaagatttccaggattcttatgtcaattccctttcaaccatagcctgaacagtcctcttctttggaagcacggacagcgatttcagcttcgcaaaaggctagttgtgcttataacgttcacccagcagcctgctggtgctctttattcatcatatgctctgtgggacagtcatgactttccagcagacataagtgatggtttgcttttgcatcttaaaggcattaatcttgtatgatctgatccatatgctttgtacagtgactgtaacaattaaatgttcacatggactcttttagggaattgcattggcttatttcagaattcaaatactgcttagtgtttttatttccagccagttcattcttatgaatctgttttcaagcctcatctcttctcctcccgtgttctcccaccatggccctcttccccatgcaaaactcctctgtacatagagttcctatggaaacataccatgtctgaccaccctctaggaagttgttgcccatcatttaatctctctttatttgattttattattcttattatttttctttgagacagagtctcactctggagtgcagtggcacgatctcggcccactgcaacctctgcctcccaagttcaagtgattctcatgcctcagcctccagagtagctgggagtacaagtgcgcaccaccacagccagctaattttttgtgtttttaatagagatgggattttaccatgttggccaggctggtcttgaattgctggcctcaagtgatctgcctgccttagcctcccaaactgctgagatgacagatgtgagccaccacacccagcccatttaatttctgtaatataatgttttaaaactttgcaacagagcagttattatcactctttgattatctattttttgtcttttttactaagctattgtctgtcttcttcactacaatatgagctccatgagggcgggaaccttttataatatattcggtgctataataccaacacctagcattggacctgacccatatatgcagttaacatatatttgttgattgaagtattgctcttcagcccgaactgaccccttcttcctttgcgctttgcattttatacatacttatgtcatagcatatttattgcatgtgtcaaccttaataaccggattcaagtgaaatgattattgaacttatttgaacacaaagtttgaggatggccacccagaaggacacagactctaaaagagtggagtcatggctccaaagtggggagatttgagggcccctcttatattggcaaggtctggggaagatgagcaggattacatcattttccatacaggattggtgaatagttaacagcaatttgattggttataagtgtttctttttttttttttttttttggaaagaatataagtgtttcttttttttttctttttggaaagaatatttaggtatatttaatattccacatgaaggatgtaatagtcaaagggtctgttgtctcagtcaaggggtcctctatctcagggccatctcctctgagccaggaataaggaaataaggtaggaaattaatctataacagaaagtcagtaattaagaggtcaagctctgtgacttgatctccaaagtcaacattcctcagggcctaatagatagactatccattttcttttacacgtgaatttgtgtgacatgccctctactcttggtagaattggtagactgtaaacttcttgaggaaagggactgtgtcttcctcctctttggttccctgggtcccagcacagagcttgttattaagtcaatgatcaataaatatttgttgattacctataggttcctcttgattaaatttaactgcactaaattttatgtaataagtttttgctgagcccgtagagtacaaagtcctcagttacaaatgtgggctaaatggaaacagacatacccccttcattcaaacatcttatgtatcttaggtatacgatgcagagactctgtgtgagggtgggtatgcatataaaatacattgaaaatccctaatttgtattccaggagagacaccatgcatctttttgttttgttttgttttgttttgtttttaagacagactctcactttattgcccaggctggagcgcagtggctcaatcttggttcactgcaacctctgcctcccaggttcaggcaattctcctgccttagcctcccaagcagcagggattctaggcgcccaccaccacgcccagctaacatctttgaatttaaggatcctttgtgctttcaggaaaatcacatttgtgttttatggtatttaaacagaaattagtataacccatgattaatacccctaacatgagggaaactataagactactcaatattccatatctatctcaggttaattatgcttcccccactaaatttagtaaagaaagatggaaaacaatgagagttactcttacccatctacggctctccaactaatacttctaagagtgtgtttgtaggctctatcagggaatatatttgctcttatgttttcgactgaataaagatttgctttagctaatgtacctggcatggattacccatccaacatcaggtcaagtgaccttaccctctctggtagcagcaaaggacaaaagaccaatcaaggcaccagatcctccagttactataaactgagtcaccttaaaagtagccaggagagtaggctttgctgttctgccacacagcatgtaacaagaaaaatggagtcatgaattcttggtttatttgggaggtatctcacgcaagataccctcaagtggccagttctaatgtatgtccttttacctaggacacaaattctttccaatatggccagcatatttctccaaacatgcataaccaaataattgtatccttttctctgtgaaagtttttaaaagatatatttctcttttattgacttaacctattactatgtctttgtattataatccaatagttttgtttctcagtagacagtaccttcctaaattttaagaaataactgctgggtgcggtggctcatgcctgtaatgccagcactttgggaggccgaggtgggcggatcatgaggtcaggagatcgaggccatcctggctaacacggtgaaaccccgtctctactaaaaatacaaaaaattagccgggcgtggtggcgggcgcctgtagtcccagctactcaggaggctgaggcaggagaatggcgggaacccaggaagcggagcttgtggtgagccgagatcgcgccactgcactccagcctgggcgacagagcgagactccgtctcaaataaataaataaataaataaataaataaataaataaataaaataaagaaataactgtcccagaaatattttgtgttatccatgtatgtataagagaaaaccatgatacaattgttttaaagatcttgaggtaaattacagaatagtattcctgtaggccaaaaaattaaattatgttctcaaaacatgagccactcatgattttttaaaagcaagttctcaccagaaaatcacctaagctctaagacccaaagccactcaaatttcactactgtttttctctgtttacagcatatagaactctttaaaattcctattgctctcactcatattcattataaaaattttaatttactctaaccatgactacattcagtaagtgctgtttcagacaggaaatggaactattatagtgatgaactcctttctcctagttattaaaggaatctgttcttatcatactgattccatccaacttattataatgcatgaaataaccaattcagtgggttcagcataatgggggagagaggggaagaaaacaacacacataataatagctgacttttaatgagaattctttagggctttcaccaagcagatccaaaataatttatcttatgataatatcaaaagcaaattactcacaagattatactgttaaggactgtcacaatattcccagggctgtaatgctgtctcttacagttttagaaccaactttataacttttgctattagttgctaagaaacaaattataattgcagctcagactctttactgtgttagcctcttaatgccccatagtagcatttatttccttcagatgatgaaatgatcaacaaagtaattgttttatatatagctgacaatgaaagcattttcaggaagcaagccacgtttttatgatttttatctggtggggggagggtagttagagcaatgattttaataacatcacgatgttgaaatggcttgaatcttagaccaatatttaatggcttccttttcaggttgtggtgttgtttgttttgtttgtttgtttgtttgtttgtttttgttggttcgtttgtgacagggtcactctgtcgcccaggcttgagtgcaatggtgcgatctcggctcaggtgcacaccatgacacctagctaatttttttatttttgtagaggctgggtttcaccatgttgcccaggctggtcttgaattcctgggctcaagcaatcttcctgccttggcctcccaaagtgctgggattacaggcatgagccacagttggttattacttagaaatcaattttattttattttttagttattatgttggatggaaagagaggttgaagagtagaaactttggagtgagactaataagagtttgaatggtagctctatcacttactagatgtgatgaactttgtgtaagtcatttaatttcctcaaaagcttagtgttcccttctgaatattaaaatgaagatattaatacataccttgtgacatcacatgggcaataaacaggataatgtatttgaagtatctagaagccatacaataagtggtggtggtgatttgtatgattgttaagtcctaaaatgagggggaaaattcttaggatatccttaaaagccttcataaagataattggctaatagagtagagtagcaatacgttatttcaaattagtacactattgactctcaagaattcataccaacgtcagatagtgacataagaaatttgttaatttattcatttatttgaagaactaactgaccattatcattttaagtactcactgataaaaggataaaagtagtggggaggtcttaatcccacagctgtaatgggcaacatgtgatcaaagagaaaaagttagtgtgtatatctgatgtgtactctgacccaacagatgttacatataagaataagataaaactagttgtcctgcaaatctacattgtgagggccaaatgttgaaacagaatgatataaagtatttccaatttagctgtagtaagcaccacagtttttattactaatgccttttctggtacgagacatttagtgtttgactgcatggacctttacagtataggagatcatgtgtgcctgttggcctctgtggaatggattccttgccctctcagccctgttcccctaaaaacatgtttaaaatctctaaaaggctctggatcttccaactctcaatatagaggcatgttctcttttatgcattttctctttggcttccacataagaataaaagactatatattttttaagtagtttctccagaaaataatctggattttaagcttctcttaaagacatggaatttctggcaaccatgtctgccattgagttcctccacatggatttgttcttctactactttgatcttacatgtaatatgcaatcacgctagcctacctcactcatctaacttttgtttctgacccttaagggcaagtgggtttgtagtccttgctattccccagtacatacgcatgcccttaaaattccacgcccgtatggatgaaaaaatgccactttaatatctataataatacattttcatttcctgagaggtaaagttgtgatgctgttggtcatagagaattaaattatctttagcatccctgcattatacgttttagatattgtgaattcgttgctgattgtaaatatctctcacaattccaaacccaagttaagtagaatattttgttctacatttaaataccacttgagcacatgagactgttctgggaactctaggaaagcaggaggcaaatcaactatggtcctgccaaaaatctcaaagcagtagaaatgggaaaaataaaaagaaatatacatggagtggtgaggttcaaatgaaaaggaaagaaaccaacaaacatgccctaagaccagttgaaacagtgtatccacctaaacgaggaataaagatgcttttcatcttaattccagaaagctcaaactcactgaattcaataaataccatttatagtctttattcatctatattcttcattcctccttttgaaactatggagaaaatagttggccatcttgcaggtttatcatcattaacaaatcaaatgtaaaatgctttgcaaagtttttaaaaaatgggaaaaagagcaagcataatactatgctgtgaatgagatctaagctgtatgctaaggatatatgcgtgagtgagcaatgtcaacgaagagtcaaactctttgaagagatattatttgaatgttaatatattaattgaaatacttgaggagatatattctgagccacatataggtgactatggcctgtgacacagccctcaggaggtcctgagaacatgtgcccaagtggtcggggtgcagcttgcttttatacattttagggagacatgagacatcaatcaaatacatttaagaaatacattgtattcctccagaaaggcaggacagctcaaaggtggggggtgcttccaggctttgggtaaattttttttttttttttttttttttttgagacggagtgtcgctctgtcgcccaggctggagggcagtagcgcgatctctgctcactgcaacctccgcctcccgggttcccgccattctcctgcctcagcctcccgagtagctgggactgcaggcgcccgcaccacgcccggctaattttttgtatttttagtagagacggggcttcaccgtgttagccaggatggtctcgatctcctgacctcgtgatccccccgcctcggcctcccaaagtgctgagattacaggcatgagccaccggtaaatttaaacaatataaaggaatgtctgggttgccataagaggttgtggagaccagttttattatgcagatgaagcttttagctagcaggcttcagaaagaacaggctgtaaaatgtttcttatcagactgaagtctgtgttgatgttaatggcggagaggtataaagagtataaagaggcatgtctgaccccagcttcccttcttggcctgaatcagtctttcaggttacgttttaagagccctggttgaggaggaagtccatttagatggtaggtgggggggggccttagaattttatttgtggtttatagcaagatacctctgcatgctgtatgaaccctttcagtctgccttccatgattgcatcttttcactaaagagcttcctagtggcgatgaagacttgaaaatgtaatacatacccataactgattcctaccttcttattctgtgtgtgtgtgtgtgtgtgtgtgtgtgtgtgtgtgtgtgtgtgtgtgtgttttaatgggaaggaaaccacagtttctaaatggtcccaccttccttattaacaaagaattagcataagtcccagaacattatagctgtttctctaagaagttgtgatataccaccgggcgaacaggagaccaggtgtcatgattcagtttggggatcgaaaactagtaacaacttcactttgaaaatcttttcagtgcccattccctggggctttcaggctaagctactgcttttatttctctgctatttaatgtataacaaaagaaaaagaaggcatgtatcctggagccctgtggtgaggaaaagcaacttaatgtttatgaagtgctttcaaggggatcataatcttaggaccaatgagtaacccggaatgagttttgtgtttctcttgggtctcctggcctgatccataaatttacttagctatgtcagggatcctagagaatactggtccagttccctaactttagaggtgaggagtgccagtgcggtggcttacgcctgtaatcacagcactttgggaggcagacgtgggaggatcacttgaggccaggagttcaggaccagcctgggcaacacagtgagattttctctctactaatttttttttttttttaaattagcaggacatagtggtggtacatgtctgtagtcctagctactcaggaagctgaggtgggaggatcacttgagcccagcagatggaggctgcagtgagccataccatgtcactgcactccagcctgggtgactaagcaagattctgtctcgaaaaaataaataaaaataaaggtaaggcagattgaggccttagagataattcgtcttgaaaaaggtcacagcagttagctgcagtctgaatgctattattaggacttcctgtccctctccacactatacctattgttttcacagggtgtctctcctttatctccagaggcagttcattggattatcactgggatcaatggatcagaaggaataagggggtgaagtaggagccaaaggaagtagttagaaactaattgtgttttttctcagcaggattcaggctttttctcagcaggatccagcttttaaactttttaacttctaaacttttctctagagtaattgaaactaacagtattttagtggtgaaatgtttgcagtgcttagaaaaatctcgaacaaatttcatgtctctcatgttataaaacagcatttgaactcaagactatagaagagttgtaacgtaaagacgaatccattttcggcattttgaaatatcatttgatcactgcaggctaattgctgctgttcctaatccaccaggttgacacttaatgaatgttcatgatgaatccgttctttagttagttgaaccctataattttcttgcttcgttttcaatttacaatatttgtaataaaggtgccatgcataattccctaggaaaggtcaatatactcttttattaaccataagcctttctggtcttctgggtgtatatttgtcagggaatagactattcttttatgatttcaaatgttagattgtacagattggttatctttactatattacctgctgaaatttctacatatagacatttagaaaattgggataatagcaaccagccttttttactattctttcaggaatgagaaactcaaacgtgtgtggggaccgggtatgtaacatgaatgagtgaacggggaatggatacaaggccaaaagagacaggtggatattatggtagactggagctcatgtgttctcccttaccgcctatactgttttgaaaacaatttaatcattatgctaggcaaacacaacacattttgggctgattttctcaactttgtttattgcgcacctccacatccgtttgatcttcgaaacacaatatagggagaatataattagacccttttttcagatgaggaaactgagttttagagaagttaaggtctttgcctgaagtcatacaactaagaagtggtagaaataatattcaaagttaaaccatactctgatgcctgtaaaaccaaaactgcactctaaggaaagaaagatcatgtgatgaatgcagttcttttcagcactgaaagaacatcaagctggaagttaagttaaataatgtgggagcattacagtcacctagaaaaagcagagttgtggtggccgacctggctggattaaaatcccagctgtgcttgtcacctgacagccatctcactttgagcaagtatttaatctctgaacttcatttccccctctgataaaagagataatatgactcacctgaccagatggttttaagaattcaataccatggctcatagaaggtattcaataagcgctagttccctttctcctacagaagtaagtgctggtatgagtatagggaagattttaaactaatgagttctttctttttgagtacttggataattatacttgagtagttcctgcttggatatactctgaaaacttggccttcttggccctggacaccctaaccccctgcagtcttatttattcattcttctagtcaaagacatgggcaagtacatgtgttctatttgtatataagtacacatttgtacatgcgtacacacacacacacacacacacacatatatatagagagagagagagagagagagatttaatatgataaattggcttacatgattatggagtatgaagtcccatgaccttctgcctgcaaggtagaaacctaggaaagctggtgttataattccagtccaagtctgaatgcttgagaaccaggggtgctgatagtgtaaattccaggccaagggcaggagaagagcaatatctgagctcagtaggcaggcaggaagcaaaaggagtgaattcctcttcctctttcattctactcaggccttcagtggattgaatgatgccaaccacatagttggggggcagtctaccttgctgagtccactgattgcaatgctgacctcatctggaagcaccattacaacacatccagaaataatgtttaagctttgcactccttggcccaaattaacatataaaactaataatcacaaatgtttaacacaaacaagttacagtgaaaatacaactggttttgtgatagatgggaactggaaggaaactcgacaatgagtggtcaggaaaacccctcagatggcaggattacattgcataatttgtgctaccaccccatgtggcggctctgctgaagtgatacggacaggagacagggatatactgggtagaagggcagtccctagtgagggccacaccctcaagcctggactcatggcccaaagtgagaacatgccttcctgttttcccacccacatgttgcctttcccagaaccaccctggcccacgctgcccccccccgcccccccatcctgtacccataaaaaccgcagaccccactggcagagcagagaggcgtggcagaggagagaagaggtgtccgaacgttgagaggtgaagaaccagctgggcatcggagactacaatcggagaggatttgggctggggatggttagagaggagtttgtcagccgaactccaggggaagacaacccttcccctccatcccctttccagcccccgcttcctgctgggagccactttcattggcagtaaaagcctccacattcaccaccctccaatttgtttgtatgacctcattcctcctggatgctggacaaggacctgagtgcaggtgcaagaggctgtcacactgaccctccactgagttgttttaacacttaaagtgtccacggacagcaaagctaaaagagcacactgtaacacataccttccggggctccggggccacaggcaacccctagatgctacagcggttctgcacagagtgttgctcctgccagttgcccagaagtgcttgtcccagcctctgcacctgcttacctgcgtgctccctcaccctcaacgggttaagatctgtgggctgcgtaagcaagctaccccttcacaagtcctgtgaagggatcaagggaactgccccatttcaatttgagtttagacctgaaagacaagaaaatgattctcacccctcaccaccatctcctgattacctgaaataatgaacagtgttggtaactatcaaaacccatctctatcattttaaaagtcattatcatgttctggaaatttttttaaaaagcttctactggagccaagagtggctcagctttcaagaaagaatggtttttgctcatgattttctgtattttaaaattattagatccatttctgtgaagtgcaattgaatggtatagtgaccaccatcacaggtcagggagagcagcttttcaggagagtgaaatctggtgtcactcttgaggccaaaaataaaatattaacctcaaatgcagtaagtaacctcagtaatttatacaaatggttctattttttatttgaactattgtttcttggcactcattcatgcaaaaactgggttagaaattggtatagttggttcatgctatgaacatacagtttgatcttaatagttaagaggaataacaaaaacttgaaggtattttaagaaaatcggccaggcgcggtggctcatacctgtaaacccagcactttgggaggccgaggcgggtggatcacctgaggtcaggagttcaagaccagcctggccaatatggcgaaaccctgtctctattaaaaatacaaaaacagccagtcgtggtggcgggcgcctgtagtcccagctacttgggaggctgaggcaggagaatcacttgagtccaggaggtggaggttgcagtgagccgagatcatgccactgctctccagcctgggcagcagagcgagactccgcctcaaaaaaacatacataaataaaataaaataaatataaaaggcatctgaccaaaattagtttaccacttaaggagtaaaccgaggagatatatagtgatcattacataccggaattattgctataaaagccatagtgtttatttggtcagtgtccgaactttttacaaggtaataatagaggaagaagaatcctgtaatgactgaattgcattttctggaattggattccctgaattcagatttagtctagttcacttaccagctatttaaccacagtcacgttatttaacttctctgagtctttttcctcatctgtaaaacagggatgcaatagcgcatactttgttggttcattaggttagctcatgcacaaagtgtacttatcacacagtcctgccatattgttttgtgggtttttgttttttttttttttgaggcagggtcttgctctgttgcccaggctagagtgcagtggtgcgatcttggctcactgcaacctctgcctcccaggttcaagtgattctcctgcctctgcctcctgaacagctgtgattacaggcatccgccaccacgcctggctaaattttgtatttttagtagagacggggcttcaccatgttggccaggctggtttcaaactcctgacctcagatgatctgcccacctcggcctctcaaagtgctcggattaccgtgcccggcctatagtattaataataatatataatgtaatcataagagtaacaactatataccatcacatcatcatcataacagaaatagctaatgtgtattgggtacttaccatgtaccaggcatagttctaagcattaatttcaagtggacatttgggaagagagaagtaattcaggcacccaagggaaatggatttttgaaatgtgaattgtcttctgtgtcctgtggccttccattttgcagacacccactcatttcactgtatgatataatttggaattatttaacccaatggaatataaactgatggaatgtgtattacttcatactatcatgataaaatagaatttggagatagaaataattgatctctcatatgacacaactgcccattcacaacattcttactgaattaagatgttcaaaagcaaactttaaaaaatacatacgtaaggatctatgatatgataatttttaaatactattatttggctaagtattctccacaatctttggaaaaatatactgtcttgttaaattcttttccaattaaattgtaatcccataaagactcctattctaaaggtcaaattaaaaagcatttatcctcagaggctctaaaaaacagtcattagaatgccaacccttaaatggaaacaccattaagctcaatagctgaatagcttttattagaattacccaatccccctagccagccctgcaaccctgctgacaccccagggcctgcaggagaggataacctctgtatttgtttaagaaatgacaagaaaaattttcttttttaaagatataacagtcaaagactttggtctttacatagatgagcatatcaatcttctaagagacacaaaaacagaaaaaaagttctgattctatctgtctttttttttctcctgatgcttttaaggattcccctgtattttattttctctttatgcctttgaggatttcctctggggctctacataatcaggtggatctttaccatgtagatgctgcattcagtcttaatgaaatgatctcgggagccctaggaatttgcctgaccattcaaaataagcatagcaaatgaaatactggtctctagaaccagattgtggaggttgaaattttgacttctcctattacctgtgtgtctctgggaaggtcctttactctgaatctgttttctcacctgtaaaacagtaattcctaatccaaggagcacttgcaagaattgaagatatgacacatgtaaagtgtggaattatgtttagttattattatgcaccctcattattaggaaattgccatgcctgagaaggcttagccctgacctagttgccaaagtggatgcaactcagatttctttttttcttttgagacagagtcttgctctattgcccaggctggagtgcagtggcgtgatatcagctcactgcaacctccgcctcccgggttcaagtgattcttctgcctcagcctcctgaatagctaggattacaggcttgcgccaccatgcccggtgaatttttgtatttttagtagatggaatttcaccatgttggccaggctggtctgaaactcctgacttcaagtgatccacctgccttggcctcccaaagtgctatgatggcaggcgtgagccattgtgcctggcctcggatttattttggtagaaaatagaggataacccaaagaacaatgtagagaggtttttaaaaaaaattaaaaagctaaattagaggagacctggaaaagtatatatctgattgcaagattaagggtaaagttttccattgtttggaactggcccttaattctggttacaatagactagaaaagtgcttatggtgtttagccatttagtagagtatccaaggaaggtagctctttctttgagaaggtacaattagtaataatgatgattctaataatagcagcaattgccatttagtgctttgcatttaccacatgccacgttacacaatttacaagcataatttcacttcttatttaggggaaaaattattatctctttttaaaatgagaaaaccaagatgaagtcaaatgaagtaatttatatggagtcacactgtaagtggtgaagttagaattcaaacctgagtttgttagattttcatcttctgagtgctactgcctcacctggatgaggttccctcttctgtatttggggccatgtaaagggattagttgtggtgaagtgaactggagagagaaaggcattgagccatagtggatctcaagagatcctctgggccagcttgctgccttccatcaggtaaatgacccagccatctaggacagatgcttgctattttttctgaaagatcttcagggatagtcgtttcacaagctcctcagaagggaaaggagcagaatcagtcaagcacagcaaagtaagggcctaagtaggcagatgtgctcagtgtcactgggacccccagctgacaagcttgctgtgcagtgttctgcttgagaactttctgtttaacatgccaggcaaatcagccaccaagtcctaagtccaggaaaatcactttattttctgtgagtgttgcatgaatttatccaactgctttggttgtagcagggcaagtttgatgtctgtcatagacctatccaccttctgtaaaagcagttcagaggatgaccaatgagctatctttttctgccattcataacttgtgcatttccttgacttgcttctgttacaaggaaaatgatcttattttttatgcaaatcttgcacataaaattgataagtatttgatgataatcagcatctgccatcaccattttgcagacatgacagatattattacttttgtttagataaggttcaaatgagcttggatttggttgcttatttaatacttgtcttctctgctagcctgtaaactctgtgtcacaagagtaattacagtgtcttaaacctactatacactgaaggatgaagacaacaaaggcagaccaagatttgagtcggcagaatttcagtttccacaaggacaagccattttgacctctctgagattattaaaatgagttttatcatgtaactcacaagattactgtaaggaattatgcaaataatggtggtattattgttatttttattatttagttcagaaatcactttttaaagatgaggaaactgactgggcatggcggctcgcacctgtaatcccaggacagtgggaagccaaggcgggctgatcacttgagcccaggagttcgagactaacctgtgcaacatggcgaaaccctgtctctacaaaaaatacaaaaaattagctgagcatggtggcgtgtacctctagtcccagctactcaggaggctgaaggggaaggatcacctgagcccaggaggttgaggctgcagagacctgtgattgtgccactgcactccagcctgggtgatggagtgagatcctgtctcaaaaaaaaaaaaagatttagaaactgagctctatacaaacatagtaagagttcacccaagttcatggacaagaagaatgcaaacctgatgcctgatgtattacttttctcagctactgtaataaattgacctacatttggtgacttgaaacaaaagaaatgtgttcttttacggttctagagactagagatgagatacccgaaacttagtaggaatgcactgcctctaggggttttagggaagaatctttgcgtcttccacctcctgatggctgccctagcattcctgagcttgtggccacatcttcccagtttctgcctctgtcctcacattgccttctcctctgtgtgtctgtctaatctccctctgcctcactcttagaaacccttgtcatcggatttagggcccactcagataatccgggatgatctccttatctcaagatccttaccttcctatgagatgggttgataggtgcagcaaaccaccgtggcacacatttacctgtgtacctgcaatcctgcacatgtacccctgaacttaaaataaattaattaattttaaaaactcttaaccttatttatatctgcctaggtcccttttcctagttaaagtcacactcatgcatcccagcacttaagacatggacattctttcggggggcccttatttaacccatatttttacatgatccctatgttttcctgacaaggattctaatttggatgtttttacaataataagtgttatactgtctgaatcaaataataggaatttctactacacaacaatcttcgtgataatggcttaatatataatctttatttcacagatgaatcatttcaagatccatgatcctcctagtttgacagaaataacataatttgcttgaatattaatgttgctcttagttttgagtgagatgtttttaaagtatctaaaactgattggtacacacatcttttcatttgcagctgaatatgtactaattctggctgtgagcttcctaagcaagaatgctagaagccaattgaattagcaaatgcactcagatttttgatagcattattccactgaatgtggaagtccttcagaaagaatcagctacagaaaccgtcttgctaacagacacctgtcaaaaccaattccattcacttagcactcacttctaatattgaagggtgttttgttataacttcagtatcttcccacccttgtgagagagaatagggtgggagagagaaatccttagtttaggctgttttgaaatgggtatagtaataataaatccctcaaattttatataagatgtatttatactttgcattttcaaaatacacattctcaaataccagtatttatggaaacattcctctgatgagtgaagatttgcaaagcagagcttagctttcataaaagatagggacatctctgtcacaccacccatgacctgagacatgtaacctccttggggaagtattattgtttccattatggttgctgaggagcagcaagttcagttgctgaattatttccacatgataggcaatgaaatgaagaaagctaaccttgtataaaatgctcaaaacaggaagacagagttcaaatgaaaacaaattcacaattagcttcatccgaaatagaaacaggtttgcttgctggaaagaaagttcacactcttcactctcgattcctatcacgcttctgcttgtttctccaaagctatatgaaggctggttaatcaccttatctattcataaagtctattaatctttcttattaacttgtaagaccttgtcagatgaggtccaaaaacaagttttaagaccttgctattactactggtaatgtagtaatgtttctccatttctagcttttacccacaaccacttggtttatttccatctataatggaacaaagaactttgagttttactggatttttgtcccttaattacggatgtttgccttcatgaaatatgacgtggttttggtttaatgaaagagcatcgaagctgtcaagaacctcagtgatttttcttttcagttcttaatcactgctatttgagggatgttttgatagtatcatttcttaattgcgttttcgaaaaatgatttgtttcaatagccacatttccagaacttgacaatcacctcactgctgctaccagtatcgtattaccttattccatgctacctaggaaaaataacagaaaaagtaaccatttcttgccttgattacagttactgactacagaataaggagaagaaaacaaaatcatgtggaacttcagattctgagacattaaaagggcccacatagcattcagttagtaacccattcctatgaaagaatctttgagaatgaatcactcaaattcctatctgagaaaaatgaccaactactgcctgccactttactagtgggccatgattagttggaaataccaaatgaaaacatgtactgccatgcatatttttcttggtggtgacatttgtagcataaagtttacagcataaggaaatttaacatgtttcaaattcaccatatctgttaggcatgctttcctgttcattcatctcttttaatagtttggaacaaataatgaaaaccatgtgccatgttttacagattctgagcctcaaagataattaaatcatgaaagaaatgtttctacatctgcaaaaaatgtctggtgcccgatccatcagtagaaaaagacttacaggcaggaagctctgctgcagcagttctcagggtatgcttaggaaggacactgattctcagagagatcaacaattaacagttcacatcttagttttctaaaagacttctgggagtctttgatgctgtaatgtatgttggatagtcccaaaaaggagatacaataaatagtaactcccagtctcttgataataaatccctttttttgttcatagaaaagcactgtttttagaacaaactttgcaaaaactgttaacatagcataagacagtggagtagaagaagagtgaaagtatcgacttgggttctaaccctggctgtacctcaaatagggcatgttaagcatatcacttgaccgctcaaggcttcaacttcctttagagatagaaataagtcatctcttgagtcctttgaaaacttacatcttccattctgtttaggctgctgtaagctgccattgactgtgggcttacaaagaaaggaaatacatttcttacagttatggagcctgggaagtactaaatcaagacacaagcagattcaattcctggttagggcctacttcctggttcacagactgctatcttgtcactgtgcactcacgtggtggaaggggcaagggagctctgtcgggcctattaggggactaatcccattcatgagagccccatgctcatgatctaatcacttaccaatggccctacttccagatacactttggggttaggattttaacagagaatttgaggggtggggtggggacaaacattcattgcataacactttaaaataccataattctctgtccatggttaagaaggttcctgtgtaatatatgtaattccattctgtaagttttattatggtctgatagttttagtaagagttatcaaacccactggaatatttaaatgattaaataacccgaaaaagttactgttttgaaagtatcacagtcatgagcaaataatctaaattaggcagattaaataccaaaattggacctgacaggctgaccctgatcctgaaaggctctgaccttttcctggtggcattggttcaaacatccatcccctctcttctctccaaaaaacatggaaaggaacttgtgtaactgggatttggtgagctcccaatacccttttctcacaactccagtgacattcccacggaggaagggactctataatctattctgttaaatggtgagaagcatcattttttcgtcttagcagtcttatattagagtaacaaatgggtatcttttttttttttttttctgagatggagtctcgctctgtcgcccaggctggagtgcggtggtgccatctcggctcagtgcaagctctgcctcccgggttcacgccattctcctgcctcagcctcctgagtagctgggaccacaggcgcccaagaccacgctcagctaattttttgtatttttagtagagacgtggtttcaccgtgttagctagaatggtctcgatctcctgacctggtgatccacccgcctcagcctcccaaagtgctgggattacagacgtgagccaccacgcccagccacaaatgggtatcttttgattcaaatttgtcttgtatccaaaataggtacatgtgatcaaggcaaaaagaaataaaaatatataacatttgattgtgagtaatcttttcattacacctaatgttaatgtgttcatgattgcagaaggtgtaaataaccatttcttagatgtctagtttattaatcacagaaatatctggagaaaagaacaggattttttattctcacagagaattgttgattgggactttcttgacccgtaagatgtaaaggttaaggttgtctttgttgctttcttttaaattaaatccaagtgcatcttaattaggttaaatacttggttttggaccaaaaaatagggacttcaacaagctacactataacttataccaactgaagttggtagcttttaccttccttcatcattgcagttcttactaaaatggaattagtgggagatgtttcttaaaggattatatttgaaggttttctggaaaccaaagtgtgaaaagttgaagcactcatcagtatggcatgacatgaatttgaagttttttaaaggcaagcaagcagaatcttttggcataccctaatctaaaaatatcacttgattagattcacttttcaatattccttttaattctatggtacggtttttaatgtgcccttatttctctaagaaaaaaatgaagagctagaatctaaaaataaaacccgtacttaatacacaagctaaatatactcccaagttttctcactgctacattaattcaatgaaatctaatttaggctagtaccactgttatgaataaagatgaatacacattaccagttcacattgtgttgtagcatttttctttgagacttatcggaagaaatgttaattgcttaagtccttacataagatccggtgttctttaaagttttcttgaagagagattaagggaaaggtgacaactaagtttgcatttatttttagcttcatcctattctattgctgtattcccaaagtagtcatcctgactttatagcattccttaagagttaactttccaaaacccagatactataatgttgctcagtaccccacccctacttcatactcagattcctacagtagcccttgttgcttataagagtattcccaaactggtgaattctgctcctgcccaatgttttgttattgttgttgttttcatagagatagagtcttgctctgtcacccaggctagagggcaggggcatgatcaaagctcactgcagcctacaactcctgggctgaagtgatcctcctgcctcagcctcctgagtagctagaattataggtgtgcaccaccatgcccaactaattttttaattttttgtcaagctggggtctcactatgttgtccaggctggtcttgaattccaagctatcctcctgcctcagcctcccaaagcactgggattacaggcgtgaaccaccactcccagaccagaatgttaatttagaaagctacactgggaatggtggcttacgcctgtaatcccaacactttgggaggccaagtcaggtggattacctaggtcaggagttcgagaccaacctggccaacatgatgaaaccctgtctctactaaaaatacaaagattagccaggtgtggtggtgggcgcctgtaatcccagctactcaggagactgaggcaggagaatcacttaaacctgggaggcggaagttgcagtgagccgagatcgcgccactgcactccagcctgggcaacaagagcgaaactccgcctcaaaaacaaaaacaaaaacaaaagcaaactccaaagagttcagtgcccagatgttagattaaacaagtccctttactgcaaagtttttttgtgcagaatgaactgaatctccaagagttcaatatagtttttaacctttcacaacttaatcataaaatatttgtaaggcattcctgtttagtaagattattctgtggaagacaaagtaaaattctagggtgttaacaatgtctgttacactatgacccttactcacatttcttgcttcatgtcttttatttttgtgcagataccttactactgtttgatgaccacactgagtattttttttttttttttggtataaatttagaaggtaaaagtgcaattttgtttcatggatatatcctgtagtggtgaagtctgggattgtagtataaccatcacctaaataatgtgcattgtacccattaagtatttttttttaatccctcccaccctcccactctttcaactctccagtgtctattatttcacattctatgttgatatgtacacacgttttagctctcacttgagaacatgtggtatttgactttctgcttgtgggttatttctcttaagataatggccttcagttccatcgatgttgctacaaaagacaagattttattcttttttatggctgagtagtattccattgtgtgtgtgtgtgtgtatatatatatatgtttatatatttatgtttatatagtctgtatatatacatactatatctatacacacataaatctatctatctatctatctatctatatatctatctatctatctcccattttctttatccaatcatctgttgatagacatttgggttgattccatatctttgctattgtgaatagggctgctataaatatgtgaatgcaggtatctttttcttttctttttgagacagggtcacactctgtcacccaggatggagtgcagtggtgcgatctcagctcactgcaacttctgcctgctgcactcaagagatcctcccacttcaaactcccaagtagctaggaccataggcacgcaacaaaacacttggctgtttttttgtatttttagtagagatgcggccttgtcatgttgtccaggctggtctcaaactcctaagctcaagtactgcacccacctcaacctcacaaactgctgggattacaggtgttagccactgcacccagctggtatccttttgatataatgatttttttttcctttgattatatacccggtagtgggattgcctgatcaattggtagttctattttcagttctttgagaaatctctatactgttttccatagagttgtactaatttacactcctaccgatggtatatagatgttcccttttctctgcatcctcaccaacatattcttttttgactttttcatagtagtcattctgactggttgtaagatgatatctcagtataattttaacttgtgtttttctgatgatcagtgatgttgaacattttttcatatatttgttgtccatttgtatgccttcttttgaaaaatgtctgtttgtgtcctttgccttttagtagggttatataggtttttgttgttgttgttgggttaagctccttgaagatcctggatattagttccttgttggatgcatagtttgcagtatttccttctattcttcagattgtctattcactctgttgattatttcttggctgtgcagaaacttttaaattaagtttcatgtgtctattttggcttttgttgcatttgcttttgaaatcttactcatggattgtttgcataggccaatgtcctcaagagtttttcctaggttttcttctagtatttttacagtttcaggtcttttttttctttgagatggagtctcactctgtcacccaggctggagtgcagtggcacaatctcgggtcactgcaacctctgcctccggggttcaagcgattctcctgcctcagcctcccaagcagctgggactacaggcgcctgccaccatgcccggctaatttttgtatttttcagtagagacggaatttcgccacgtttgccaggctggcctcaaactcctatagtttcaggtcataactttttcacatgtatttttagaaaaaaattttaattttaatttttatgggtacatagtaggtaatactaagcctttcacatagctcgagtttatttttatatatggtgagagataggggtccagtttcattctcttgcatatgacaatccatttttcccagcaccatttactgaatagggtatgctttccccagtgtatatttttgtcaattttgtcaaacctcagttggctgtaggtatgtggctttaattctgggttatctattctagtctcttgatctatgtgtctatttttataccagttccatgctgttttggctactgatagccttgtagtagaattcgaagttgggtaatgtgatgccatctactttttttttttttttgcttaagattgctttggctattcaggttccacaggttgctttattggttccacattaattttaagatttaaaaaaaaatgagaaatgacatcggtattttgataggaattgcattgaatctgtagattgctttggataccacagtgcatatttttaatgccttttcgtcattgtgcatgttgttctttaccctgacattcgatttatttcttctttcttctctcaaaatcttaatttttttcgggtctagactgcatgttatgtactttcttattattttttatcctgcaagaaaataatttgctttctcatttgtaatctcacagcattttgtttacataccactaaagttcttattatctgttttgaatctggtaattgtccacatcttcctacaagatgaggagttcttcaggggcaggagctttatcttaattcatctttgcaactttcatttcttagttctctgccagacatgtaataagcaatcattctggttgaagagaatcgagttgaataactacaaaactgtaagtcaaaccatgtcactcctctgttcagaaacctgcagtggcttccatattgactcagactaggaactaaagatcttatagaggtcccctctctgtcccaatacctccctgactccatgtcttaacttttatcttccttattcattctgttccagccaaactggctctgtgatattcctcaaacatgttcagaatcctgtctttaagagccctttcttctacctgaatgttttcccgtaaacattcatctggctaaaccccttgccaccttcaggtctctactcaaacgcacctacttcctgaaacttacccagagtccatttttaaaaattatagccttccttcctactcccagctctctcaatccctctgattctactctgtttttcccattaccactgcatgaccttctaacacactatgtcatttaactttttatcatggtattattttcctgcctcacctgatcagatgtaagttccacaagggcaggagtatttgtctgctttgttcattgttgtgttccatgaccttaaagcaagatctggactctgctttatgaacatatgttaagagaactgaatgaatgaatctggtttttatcccattttctagttcagtgaatttgtgatgtctgtttgtcacagtatttccatatagaacttagtaatatcagggtagcttttgttagttttcattattgaaaaattgttctctgtacttcagctcactcaagctgtgaaagcagtgaaacattgcatcaattaaaatattccaattaacactaatcaagaggagcaatagtaataacatagctgaaccaggttgttgaatctttgtagcctcacacatcactgtaggcacagtatgtcaattaaataagataatttttccctattatgcatcttggtaaaataatgaagatattctttggagaaaaataaagcattattaaaacatgggtccctgttttaaaatagcatgcttctgctcttcaatccagtatagcattgcttgtatcattgtcgtgattaagaataaaatttcatggcatgtctactctgtcagacagtgaggtaggttttgggagcctaggaaatatgagatgttgtttttgccctcaaggagattgtagtctcccctgaaagtgtttttttattctggtcctagataatgtacttattagaggtttaattctaagcaaacctcttaacttttctgagtttcaaatattttctacaattaaagtttatacttaatgccatccatgtctgcttactgagatgttttcttaatcaaatgagttattagtaaaaatgttggagttttctctatttgctaaaaataagtactataaaaatgtaaggaaacatatcattattggtctagttgctgctactattattattacaactacttctaattttgttcttgccattattatcattttaaattattattgttaccatcattatcatctttttcataatcatttttatgcctgaagcatgggctaagacactatatttaccagtaacatgtatccagtgcccaccaagtgcccatccctgaaatttatcgataaccctcacatcaatccttttggagtctttgtggtcatttgtggacttgtgaagagcagcaaaatatttaagtcacccaacacttattttcccagctgaggttgaacaaagtgacactctgccttctcgtttgagctctaggtgtacaaacaagtgagctttttgctgtctgtttagtggcacgttgttttgccttctttgcttttttgttggtgatttcactgtttaaaatagcccaagggaatagcaccgaggtgctgtctagtgttcataagcataagaaaatcgtgccttacagaaaaaatacgtgtcagatgagcttctttcagaccacgaattcaatgtcaatgagtcagcattatgtattaaataccatgtcttcaaacagaaacaagtaaagcaaggttatgtattgattggttgatgaaaatggtgtgaccagagactcgcagaaacctaaccctgtatttcccctacggtttagcagtcactaattcagtgcttggggcaactttgcagagaacataactacagccagtaatgtaaattgactgtagacacccggcagtatggtgctgaggctgaaagcaattgagaacacaaattgtcttaaatgacttgacttaaatgagaacacaaaactttaatacttttagaaaaaaaaatgtaggagaatatctttatgacttcaggataaagacgagtttcttaagtaagaaattaagaatgttagccttaaagaaaagactgatgcattcataggactgtcgtttatcaaagaataccagagagtgaaaaagacagagatatagtaggaaaagatatttgtaaaaatgtaacaaatagaggttcccaagtgaatgaagaactccaatgagtcagtaagaaaaataaaaatcctttatataactgggtaaatgatatgaactggcattttcagaatgattaaatgtgaatggcccataaatatatgaaaaaccaactttattaatcatcaaagagatacaaattagaaatcatgaattatcatttcagacaccagattgacataaactaaaatagtaagtattgttgaggaacaacaggaattctcatttagggagaaaagattgaaaattgtcccagccattttagaaaacagattgtgtaaatatcttgtgaacttataaatctaaacttgtattttccactcttaaatatacaggctgtagaccaaagaaactcttgaaaatatgtgtaagacacaggctttttatatcagtttagtttataatagcaagtaagtgggaaaagaactattgatggacagtggaaagaatatattaactatattaactgtggtaaattctttttttttttttttgtttgagacagagcctcgctctgtcgcccaggctggagtgcagtggcgtgatcttggctcactgcaacatccgcctcctgggttcaagcaattctcctgcctcagcctctagagaagctgggattactggtgcctgccaccacgcctggctaattttttgtatttttcagtagagacgagtttcaccatgttggccaggttggtctcgaactcctgacctcaggtgatccacctgccttggcctcccaaagtactgggattacaggtgagagccaccaagcccggcagtaattcttatgaagaaccgttaccacacaattaaaatgaatgaaccacagctacacccattgagactgagtctcaaaggaatcatgttgagtaaaaatagcaagtgttagaggaatgcatagtacaattccatttttatgaagtagaaattaatttcaaggctgaacaatacattatttagggatatatatatatatatgtctgcacacacacacacacacacacacacacacacacgtatgataaaaaccataaagaaaaaacacatgacaaacaaaataatcagcagtgggggtatagtcagggaggaatacacagaagcttcaacattactggcaatgcttcatttgttacagtgggtgttaggatcacaggtgtgcactttagtattcttgtaactctgcataaacattatttgttttctttgtttgcctaatatgtcacacaataaaaaatttaaaatgaggaaaaaccatcaggttatctggagcaagacagcctgggttagtattctggcattatcgtttactaacaatgtgtacttgagcaaattattttgctgttcagcaatcagtttccttatctataaaaaggaatataaaattacccactttagggattgttcagaggattcgattttatgtattgttaatatgtgaaaaacacttaggataatgcctagcacataggaagaactcaataaatcttagctctaaatactactattcaacctacaagtggctgaattagctaacatacaactaagcaaggaaggtgtgagcattgctcttctatcacttgaggaccaggatacctcatctgagatctggaatatcttcactagctcacccaaccacacccacatattttgagcactttttttttgagacaaggtctctctgtgttacccaggctggttgcaaactcctgggctcaagcaatcttcctgcctcagcctccaaagtagctggaattataggcacacaacaccatgcccggctattttagggacactgaaaagtgtctttatcggccaggcgtggtggctcacgcctgtaatcccaacactttgggaggctgaggcgggcggatcacctgaggtcaggagttcaagaccagcctggccaacaaggtgaaatcccatctctactaaaaatacaaaaaaatttgccgggcatggtggcaggagcttgtaatcccagctacttgggaggctgaggcacgagaatcgcttgaacctgggaggcggaggttgcagtgagccgagaccgcaccatcgcactccagcctgtgcaacaagaacaaaactctgtcttaaaaaaaaaaagtatcagttgctgcactgtgtagcatcctgatcactgttgcttcatctacaatcttttaagaagcctgtggcaattcaagtgccacatgagctttgtagctgtaaagtttcttgtgatagaagagcaattggagttgtgctagaattcagttgctgaaaactgcactaggaaagttgcaaggcaaagacaaacccaaagaaatcagaatagaaaatgatctcaggagcaatgttgtgacgatggaaagatgacaggccagtgctctgacatggaaaatgagaatgtagctggatattagcttggctcatatttttgaaacccagagcatgagtagtctcaatattgatagcctgggtttgagtaactctcttaaactcacttgatgccaaagctctcatgagaatccagttgtgccttgtggtgaggtgaggctgtaccttggcactgtctgtgcacactgacctgcattgaaaacaatgggggcagtgagcagggccgaggtggagattgagaggaaccaggtcgtggatgccaaagggggagaaattggccaggtttttatcccggaagctaaactgaaaactcaagtcccttgatcctcattgttctgggtccacagtctgtgcagatggaatgttgattgggtgatcaccgccagcaaaaagtacagactgttttttctactctcataacactttttgttttgttttgtttttgtttttgtttttctgagacagagtctcgctctgtcgcccaggctggagtgcagtggtgagatgtcggctcactgcaagctccatctcccgggttcacgccattctcctgcctcagcctcccgagtagctgggactacaggtgcccaccagcaggcctggctaattttttgtattttcagagagacgggggtctcaccttgttagccaggatggtgtcgatctcctgacctcgggatccgcctgcctcggcctcccaaagtgctgggattacaggcgtgagccaccgcgcccagcctctcatagcactttcttatactctacagcatttactctaaacacttttacagcaatgctctacatactttctttacaccttacagtagagccactgatgtgcgtatcatatctggattgtaaacgtcttgagatcagggaccatgttggattcatcttcacattcctcacaacatcttccacacatggcaccacaagtaatattgacgaagggagggctgtcaggccgcacaaaggatggtaaggtcttcctaactgaaatcctctggcttcctaggatttcagaggcagaaaacagtaactatccatcgctgacacagatgatcaccatgctagtttgttcattgtcttctcttatcaaatcagtgtggatttcatatgtctcctcagttgtttctcccacttcttcagcagcttagaagttttgttttgctggggagctgtttttaacttttagatataaggtgaaaatgcttatttattagtttcctcaggtgttacatgaactaagatgacttccacatcagttataaataagaaagtaccaaactaaatcaggactgctgtgtcacttggcactacttcacgtccttcttggcagcctcgatgggggacgagagctgagttggcaaaggggggagtgatttatcctcccacacttagaagtaggatggaaagcagaaaggttctacttttatattacttcttcttttcaaattttcatattaacatcccctatccggtttctctagcttatttttctgtagtgggcatcaacgacactatgtgtgatttgtttattttatttgtcatctcttacccacattaagctctttgagaagagagatttttgctttgttttgttttgtcagtgatatatccccagtgtctaaaacagtggctggcatcatgataggtgccgatagtaggcatactgtaggtactgaatgaatcttcgttggttcttaactaccacaaagtgcacttaagagcaaggggcatgagcaatggcatttctaagaactgacaggtttaacacacggcagccttatctctgattcttctttgtgaaaatgagaacagggaaacagcacccattgcaaaatctaaatcgatgatgaatgaacacgtagcttgcgtgtatatttgacgatggttttattttcaaaactgtaattaaatgagataaaaatatatggttgaagttgccgaagcaacttaaattcaacataaataacagctgctcctcatctgggaatttcatttatatacagaacttttttttttttgcccttaaaaatttttaactggtatacagctaattcagcatccagtatcccaagatacactttatactcaaagaagatggaaaagagaagagaaacagccctcgttgagccagtgatgaaacaaagctgttactccccatacctttgatttccctaaaatagctatgatgcaaagcatgtccagtttcttaggagcaatgagtctaagcatgactggcattttttaatgagtccagcaatccctactttaatagttcaaaatcctgaaactgagtacagagtgaagagtcttctattagctttgaaagcaaaatttttctgcagagcatggatgccaggaagtactgataacatctgcctctccttgtaaagtaaggatcagtgcagtttcctcccaagcttcttggaggaaaaaaatacctactctttggatagaattaagagaaggtataattacttgaacatcgatctagtttcatttgcgagtaggaagtgagaaactgcgcctctttcctgagacatcgtatccactaccactaagtgctaggcaaatttggtagtgagttcactgcctcggtttatattcctgaaaggctaataaaagaaaagaaattgaatgaaaaagtttgagatgaagagatttctttcactttgaagcagggtttttcatgaccaattgtatggctcgtagatttgtagtctctggggtttgatcatgaactgtggtccttatgtctccatttagtaatatgtttccaaggcttttctgtagattactgactttatcatggcctcttgatgcataacttttcagcattttcttcagagaatattcattctggtgttacttgaatgtatctgatttgccttctaaggtgcctatttattaagaagattggtacaatgaattacaacctgctaattttaattttcattggggagaaaaaaaggctataaagtaaaattcaaaatgaagaatcatatttctttctgtcaaagctataatgagcataagtctatcagttataaaattatcacactagatgaagaaaagataattgtatgatatatcactgactggctgataacagccctaatcacaaataataggcccatgcaatttgcaaggagttgtttcatgttttcatcatctctggcattccctggggcaggggtgagtgggcgagtgggtgggagagtatttattttgcaaagcaataactccagttcatatgttgattacattccaattttaatttatctcttagctttccacttaaggatggggatgcgggaaagtaggtggctccatgcccttgattggacaccttttcttgaagttattctccaaagcttccctggctattgagcatacaaaggtcctttgtagccaagatgctggaaagcagtgtgtcatgaggacaaatacaagaaagttcaccctagtccaacaggtctcaccaaccaccacagcctgtgaaacaggaagaacagcagtgctcaacaagtactaattaagtatctactatgtatcagacactgttttgggcattggctatagcctcataaaaactggcaagattcctgccccacagtgagcttttatttggggaggcaatggagacagtaaaaaagaaagtacacaaatgagaaccgtagttgcagatggcggcggtggtgatttctgggaaggatgtagtaaagaggggatgtgacagagagtaactggagtcaggtcacggttgactttacttaagccctcaggtaatgctgctctgaagaagggtcatttgagttggttcctaaaggctaaacatgataagccaaagaatggggaaagagcactccaaacaaggggaacagcaaggacatgggtcctgagactgggttagctgcaaggtgtttgaagaacagaaagcaaaatgtggccattacggtataactaagtaaggagggaagtggcagggagcaaagctggggacgtaggcaggggctggatcctgaagggcctttgcagagcacagtgaagggtccatattttattctgaaattgaccaggccaaatgccttctgaaacctttgtttctctttgtgttgtgtaagtatgaaaccaaagataaagaatgcagctgcctaaccattaacactcctgagtcaggatgatatgagaaaagagatgagctcccgtagagaaaaatgctggtaataatagcttgcatgttagggcacccgtctccgaaggagaacaacattattaacggtgccatatctcactaattgtagtaacctcatgagttagataggtgtacttttttgtggaacacacagggaaactcagacattttaaattaagttgttctttggcctcttaaatagcacaaaggtctagataaaatagagtatgtcaaagaaatgaggaaaaggaaagaactaaaatgagaaataaaaatagccatcaggaacgctgtaagctcccagagaaaagggcagccaagcaacgtttattttctgtaaagtcaagaaaataatagttgaggggtgaaaaactgtgagagtctcagacagtcaaacagaccatcaaaaagtatggtttcatccctgttatttaatttgatatagaatagaagttatatatagggacttctgggtcgggaaaatccggattctaatctaagctcttggatgtttatttttctttctattaaatgagaatagtaatagaacccacctcaaagagtcgtggtgaagaccgaatgaataaatacatagaaattgagaaattgtgtcatttagctaagctggatggaactggccttagcattcttccaaatagataatatttataaagtggttaaattgccaaagttaagaagccttcttaacatgtaatattgattatgctatttttaattcttgcctaggttttgttcctggaaacaaagagtgatatgtgatctagtaatgtggtgcaagaagagaaagaggagaataacctccaattttgctaaatagaggattgctgaccctaggcaaatttgtctttggcagtctccacacaccactttcctcatccagttttttaagtcattatccttcttgaactttctcagcgctattttgccttctccactatttcatagattaaattttcctttgattcttctttggttattcaaaactcacatttgaagactccatactgctcttacttacttgttaagtgaaagcaacctgattgaattaattcactcttcactgaaagtgattaatagcaaggtcatacttttgaagaaggtatttatggtttaaaatgatatttttgtaattccaaagtaatatctaaattgtaaggttttatttggtatgaccgaagagggtgacaaaaaactcaggcagttggagagagaacactgtgagggctggaatcagcacctgggacagctctgaataagctttcccttttactctgaaataagtgtattaaggatttccatagtgatgttcatggctgcagaattagaggctctgaaaaaaaaaagaaaaaaaaaaagatcagaagtcatttctgtgaatgagtcatttgtatctcaagggtacattgacttaggaatattagacctagcataagattttggtcccggccaggtgcggtggctcacacctgtaatcccagcactttgggaggccgaggcaggcgtatcacttgaagtcaggagttcgagaccagcctggccaatgtgggaaacctgtctctactaaaaatacaaaaattagctgggcatggtggcaggtgcctgtaatctcagctactctggaggctgaggcaggagaatcacttaaacccaagaggcagaggttgcagtgagctgagatcacaccactgcactccagcctgggcgatagagcaagactcagtgtcaaaaaaaaaaaaaaagttttggtcctttactttatttttattttattatttatttatttatttatttatttgaggcagagtctcgctctgtcgcccaggctagagtgcagtggcctgatctcagctcactgcaagctccacctcctgggttcacgccattctcctgcctcagcgtcccgagtagctgggactacatatgtgcccgacctcctagtcccttactttcgactgccaacaaactggggtaattaatgtcaggtttttgtttttgtttttagacggagtcttgctctgtcacccaggctgtagtgcagtggcgcgatctcggctcactgcaacctccgcctcccaggttcaagcaattctcctgcctctcagcctccagagcagctgggactacagcacatgtcaccatacccagctaatttttgtatttttagtagagacagggtttccccgtgttggccaggctggtctcgaactcctgacctcaagcaatctgcctgccttggcctcccaaagtgcggcgattacaggcatgagccactgtgcccagccaaaaatcacatatatttacatcctttaaaaaaggtaaggccgttatcctcagcaaattgacagaaaacgaaataccacatgtcctcacttacaagtcggagctaagatgagaacacgtggacacataaaggggaacaccacacactggggcctgttagagagtggagggcgggaggagggagaggatcaggaaaaatagctaatgggtactaggcttaatacctgggtgatgaaataatctgtacaacaaacccccatgacacaagtttacctgtaacaaacctgcacatgtacccctaaacttaaaagttttaaaaaggtagacaaatatcaattttactgttgtatagaaacaatatttttaagtaacacaagcattctcagaccagaagattataggaagaatttctcatgaagaattatctgaatccagggtatagtgcgtatatcttaaatataagtgttataaagaatacagttcatgcaatataaaggataagatatctgattcacttcagcatcaatcttgacttgaaagcataattaggactagcagaagaggatatattttaagtcttatcaggtttgttttttttgttttgttttgtttttttgtttttttgccacagtagtgttgacttggccactctaatgttactttatccggtggaagttctcccagtgagtcactttctgtaaactttcctttggatgctcaaaagtcatactgatagtgctaacatttatagactactgactttggaccaggcagcatcttaagtgctttacatgcatgatcttaatcttcagaaagtcctatgagacaggaattattgtcctgacattagaagtgagaattgaagttcaaggagattaactaactcacctacatcatacaggtagaaagtaagagtgctaagtttgtactcaggtccttctgactccaaaaccagggtgttaaaccatcaggcagttcttcctcttgctatatactctcttacagggaagtccagtcttccttcttcctaaatggaaagaatgtcaaaaatacgactttgaaactcaggttttgtaaatttcgatttattttcactacaagtctcttcaatccaggaaaccataaagtgtgcatccacacacacacacagggagcaaatggcagagagtcaagacataactttaaatttgctgcatgatagtgagtttttaaagttactctccaaaaatacttctttttataaatggtgcagtcatcattatggagatcatattcataacaaatgtatcacttgaccatttttccaagttgatgttcatctccttactgattgcgtcttttaaaaggaagcaataacaaagggaactggtgctgacaatttcttgttctaaggccaacctgggagaattaatagaatccaggtctacccaagtcaggaaaaaagtgaattggtatttttttacttgcattaaataatacatgtattacatgcatggttactgtatcatttttcctttttttcttttctcccttctctctgtggattcttaacaaactatgatgtgtgatattatctcattaacctttcctggccattttaaaactaaactttttataccttcctctgagtcatcccaccctgtgaatagcttcagctcttcctgtccatatgtgtaatggctagtccattaattatgacctaaataaattactctttcttatttactgttattacttctcaaaagagatcttggaccctcttgattttatatcctctagactataatcaggtatttatggtaagatacttcttccccagctctaaatatttaaaaatttcccagacaaaaaatacgtggacattttccccttgctctctaatttactccatggcctgaattccaaatgttttcctatattaagactttttattattgatagcatattgcagctttaaggcttttgtacacgtccactcctccaggaatgtaactgctaaatcacttcctctctggtctcaatgaggtaacacattccaaatactatagcatgttttctaatctcattttaaaatgaaattcaggtattacattccataggagaataaaggacagctgttttcacaaatatgatatgaaaacacatctgccacacaattgtacaatccttagcacatggctgttggaaaaagttatgtaaaatgctgacaaatgaaatcaacaccaaaaagtagaggtatttattttttaaaaatctacacatcacatgtcaatgaaccacatataaagcttgaaagacaggctattttgagaaacaatggtgcacggatgttaattccttgttttacatacacattatttattcaatactatctttggtgaccaattgctaaacggaatacaagccaagtgtaattgtttagctaccttcctaacaaggcagcaatcctgcttcttaatagagttgtttctgtttattttctccttgttcaacttcacactttgcacctaacatttacaatctccatgttgagtgcccaaccacaaagaaaagcagaggaatagaagatttgaaaccaaagtacttataccaacccatcacactatgtgttgaaatgtggatttctttccatattcactgagtgtaaatgttatttaaatgaacgtttttgtgtcctggcatggcaagtaactgatttgaaagctctttttcactgactttacgaaatcagtgaagatgccacagattatggtgcttcagagcagtaactttggagagagacaaaacatgagtttgtatcttctggccacttcctaggcacgtgaagaaggtgctgcacctccgtgagcttcagctgtgtcacctataaattgggagtttaaagtgtaatggaattcaatgagatcaaataagaaaagtacttggccacatggtatgactgcaatatagtctgcaagtcaattctattgttgctattagtgtgatggccacagtgacagagcattatccataatgtatattccgtctcataatgcctgctgctactgatcattacccaagtaccaaggctttggagataaaatgactctggatcctcatctctcaccttatacaaaaagcaactgaaaatggattaaggacttaaacctaagacctgaaactataaacattctagtagatgacattggaaaacccttctggacattggcttaggcaaggatttcatgaccaagagaacccaaaagcaaatgcaataaaagcaaagataaatagctgggacctaattaaactaaagagcttttgcatggcaaaaggaacagtcagcagagtgaacggacaacccacagagtggaagaaactcttcgtcatctatacatctgacaaaggactaatatccagactctacaacgaactcaaacaaatcaataagaaaaaaatcaaacagtcccatcaaaaaagtggactaaggacatgaatagacagttctcaaaagaggatatgcaaatagccaaaaaacataggaaaaatgctcaacatcactaatgatcagggaaatgcatatcaaaaccacaatgtgataccgccttacacctgcaagaatggccataatcaaaaaacagtagatgttggtgtagatgcagtaaacagggaacacttctacaccactggtgggaatgcaaactagtacagccactatggaaaacagtgtggatattccttaaagaactaaaagtagaactaccatttgatccagcaatctcactactgagtatctacccagaggaaaagaagtcattgtttaaaaaagatacttgcacatgcatgtttatagtggcacaattcacaatagcaaaatcgtggaaccaacacaagtgcccatcaatcaataagtggctaaagaaactatggcatatatatatatatatatgatggaatactatgtagccataaaaaggatgaataaacagcatttgcagtgacgtggatgagattggagactattattctaagtgaagtaactcaggaatggaaaaccaaatatcgtatgttctcactgatatgtgggagctaagctatgaggacgcaaaggcataaaaatgatacaatgaggccggatacagtggctcacacctgtaatcccggcactttgggaggccaaggcaggcagatcatgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccaggaggcagagcttgcaatgagccgagatcgtggcactgcactccagcctgggcgacagagcgagactccatctcaaaaaaaataaaaaaaataaataaataaaataaataaaaaaagaatgatacgatggactttggggacttagggggaagagtgggaagtggggcaagggataaaagactacaaatatagtgcagtgtatactgcttgggtgatgggtgcaccaaaatctcacaaatgaccactaaagaacttactcatggctggacacggtgactcatgcctgtaattccagcacttttggaggctgaggcgggtggatcatgaagtcaagagatcgagactatcctggccaacatggtgaaaccccgtctctactaaaaatacaaaaattagctgggcgtggtggtgcatgcctgtagtcccagctactcaggaggctgaggcaggagaatcacttgaacctgggaggtggagcttgcagtgagccgtgatcacaccactgcactccagtctggcaacagagtgagactctgtctccaaaaaaaaaaaaaaaaaaaaaagaacttacccatgtaaccaaataccacctgtatcccaataactgaaggaaaaaaatttaataaataaataaaaatatatgtggaaacattgctggtaaaggcttaatcatgagtgtacaaactttgacataatacccatttacacacatagctcttgacttagaaaagtatcatgttgttaactgttaggatctggatagatattcatacctgaaaagaacaatttgaggcatgtaatctttccctaaacatgtgcataagtatcatgtcctttgattcacatctacagcttgctctagtgtgcgtttgctattagaaacctttccttagttgcaatgtttgggatatgctttggcactaaatcacagcattcgcaatggacagaagaaacataatgactacatacttgaaacaaagaacattcattctcgttacatttatgagaaaattaagacctgcccatggtatgtagacctgcccatggtcaacacagctaataagtggcagagatggttttcaaactcagatctacccaaatacagtctttccatttgctgtataggtagggtttatcatctggaatctatttcaattaatgactaataaacgtttctgattattttctcaaataccagattaatgagatacacttcaaatgcctaaaacttgtagaagtgaatgaattcataaactaagaaggaaaaaacatgaatacagttttttaaagctcaggaaggatagttaaaaatcattgcccatatttctcattttctttctcatttcttaatactatttctctaatcagaaaccatgattggttttacctagatgatacgtgatctctactacctatcagctcttaatttttcatgcaactctggaaattgaatgggatatctgtgcacaaatgtagatgacttactctaagaacctatatgcagaagtgacaattcagactgattcagtgttatttttagggataatggtttaaaatattaactccataacacagtttttaaaatcctggtttaattccttttgaaggaatctcagaccatttccataaagacaagaaaaataccatgttctaccctcacctggtgtccattgaataaaaagaagtttattacatcagaaatgtaattcaaatcatagcactgatttgttttgtgcagagtatgtgtgtgtccttcatgttcacttttcacagcccaaacctggcagtctttggtttgctctgattaggtgttatgtgtcagacctgcctgcttgagccccaacaggacggaagctgtgttctcacaatgcttgccttctgagttggcaaaatcagatggtacttaatggagtttttatgaatatataagtgatgaagacaataatgtacaaacttaaaatgtccctaattccagaagaatctggtaattaagacatgtctatatgtaactttttaaatatccttagcactccttgaaactaagcctgagtgtagaaacattccaatttgtaactgcagccttcccaattgttgttaggagtacatgagataatcatcataaaatacttaccaaaatggccagcatggaggaaatcatccacaaatgttactctgctctagtgtgcacagccagatggtttgcaaccctgcacaacatacttgaattggaagtccccgaatccaataaaatgttattaaatcaaatgtaatagacaacaaaaaacgaaatggcacttaacacactccttattgagaggatttacatctgggagggtggaagaaaaaaacgtttcttgaacaataatatgtctcactttattagacatatttcttatattaactcatttgtatttgtaactgcctatttacttatactgtgatctttgggtttataaatgtcttatctctctaaccagacttgacctttttgaggtaataaaacattcttctaaaaagaaccatgaacagtaccttctaaatatttcaaactacaccacaagaactttaaaacaattgtgtgtctgtatatatgtctatttatacattttatatagagttgtgtttgtatataaagagagacagtcacactctgggtatatatggagagacaagtataattatatatgatagaatggtttgtgaagtgaacagaattgtatcagaaaacaagagtttgcattctgataatgatatttaaatacagagaggtcttgggcaggtcacttaacatctttaaacctcagtttcttcacctagacctgcactatccaatgtgatgtcctggcatgatggaagtcttctgtgtctgtgctggccaaggtgataatcactaagtgcatgtggctactgagcacttgaaatgtgactagtgtctgaggaactgaattataaattgtatttaattttaattattttaaatctaaataggcacgtgtggtaagtagatattttagtggacagtataaccataaaatcaaggaggatgggacaatgtcatatgaaaagaagctctcctgaattcccccggtatgggtgctaccaacgcagttttgagcagaatgattctcttttgaaatagtggtactctcccttgatatcttaggactttaaagtttaaatgctttttcccatatttctcccaacagatcttgacaactttaaaacaagaacaagaagcactgtgtctgtccgtcgaggtcaaggaatggtgctactgtgtggcccgccaccccattctggaggtacatataaatgaactgacatatgcatgcttcactctctgttatttttcttcctcaatgttctccctcctgacaccagctgagtgcacagtgtcatttatagagattcccaaagcccctccatgtggaggaaaaaccacggtgaatgcctcccatcattaggacaggaaaataccagattgtgcaaattttccaccccactgcagtgtacctggcacaagaagaaagacacctgagtcgatcaaaatcataatgctgttgcttggtaaagcagtgtaattaaaacgactcatacttcttacaacttgattgggttaaaaaagatggccctacttcatttcatctcctggttggtctgggaactgtctgtgaactgtgtctactcgcaatacttctgacaccaaatgtatgggttttttccacactaacaaccaagtctccaatcttctggacaccaactggctgtccaacgattcaattccattttgacagtaactaccccattaactactctgggatggttagtgtcagaactcataggataaaggctcagtcccacaaggctgcctccacttcagatgccactttcaagtccttgacctcacacacttctgactaactggctataaagtgggactcccataactccctccttggcttccataatttgctagaatggttcccagaactcagggaaaacagtttacttacataccagtttattataaaagatattataaaggatacgtatgaacagcccgataaacatatagagagagtgaggtctgaagggttgtgaatgcaggagtttctagacttgtggatcctccccacatgtagatgcattcattaaccctgaagctctccaaacgctgtcatttagggtttttatgcaggttccgttgtgtaggcatgattgatcgaatctatggccattgtaattgatggccattttccagcccttctcccatccccaagagtggggaatggggaggctgaaagttccaaccctttaattatttggttggttcctctgacaaccaatcaaggggcctcaccaagagtcacctaattagcataaactcaagtatggttgaaaagggcctatttatgaataacaaaagacattcttctcagcaatatcactcaggaaattacaagggttttgggatgcagaccaaatatatatatttcttattaatcacagtatcacaggatcagaccaagaacaaaagttccttgaccatagaatctacgatcactttgtggagactcatagcaactagatcagttaggaatgcacttgactgcaactaactgaaaacccagctcataatgttcttttatattctttttctcacatgcaacattttctctttcttttttttttttttttttgagacagagtctcgctttgtcacccaatctggagtgtggtggtgcaatctcggctcactgcaacctctgcctcccaggttcaatcgattctcatgcctcagccttccgagtagctgggattacaggcacccaccaccgtgccaatttttatatttttagtagagataggatttcaccatgttgaccaggctggtctcaaactcctgacctcaagtgatccacccaccttggcctcccaaagtgctgggattacaggcatgagtcactgcacctggctggcatgcaagattttcaaagatatacaatctaaagctagcacagcttctagaggatgtcttccaggactcatgcccttctctgattcttctctgaagtgcttagcatgtggtatggatgaggcatgaagtctgcattccaaaccagatcaaatgggaagaagcaaagacaaaaggcaatgatttgtttttgcttgtttttgtccatttcaatttacctttattatcgtaagttttctttgcctgaggactttgcctccatgtcattgatcacctcagtggcaaaggaggttgaaaaatcaaatattttacgcagatgtgttatgccctggaaaatatcataattttactagtaagggagaacatggagagatgtgtaggcaacttgcagtgtcggctaaaaggaactacgatgactaaaaggcaaatataactgcacataagggattcagtagtgtggaggtttaataagtagtaatatttattaggattccactaaggtctgtaatgacaagattgataaactctacccttggaaatccaggctgaagtttagttcaatatctgctattcttgttattgccttaattttcagtttgactttccacatgtttaaaagaacaaacttttagatttggaatttgaaaaacactgttttatttttgtcctctgttcaaaagttgtaatgttttctttctcatctaattctgagctaacatttccagcagaaaataacaattagtaaaggtgctaaaaggcatgtacttcaagcatcctgaatacgaaggagaggtgggagaggtaggttcccctctatgtctggatcagggacaaggaattgttaggatttctggtttttgaagactgacagaaaatctaggtttgatttcagaggtctgtgtttggaaaatgggattattcttcaggatttcattttcctttcaagttagtatcagaagcactgaatttggactctgggatatgagttttgatccttgttctgtttcaaatcattatttgatactgggaaaatatcttcaaattctttatgcctcactctgcctgtctataaaatgaagagattaaaagaagtctctcaaatccctattgattctatcaacacataattataactcgataagggctaaacatcttgtttatcaagtgtgtttgcattattgaaggcctgtcctttatatgagaaaaccacttcactgtggacatatatttagattcaggtgaagttcacttagactaacacttctctttttaatatggaatctgatcaaaataaaaatggaagattttactaatttcttctgcaggctaccttcattgcattaagttttcatcacatggcagcaaccctaaaaattaatcttgtaggtatattaagaaaaacaccaccactgtccgatataatgatctctttaggaaaggcaaaacacatggagtgatgctgtgctgctacgcaatgaagtacctgactactttccctttcccacagagaaatagattaaaaatttccatagacatctactgaaatgcagttgtctctgctggcagcagtcagcagctctgaaatccagttccttgagctgtgctgacattcctgacaatcttgatggtgaaagacaaggaaataaatattcttattataagctctattagaaatggcgtgcacattaacgctgtgggcaaagcaggcacggctaagaaatttttgagaaaagaacaaagaagatattcaaggttataaaagagcatctcagacatccatcagttttggacaagggaaacaatgattatctgatgaaatccttccaatttctcaaaagcctccaatgcaactgaacggcagtgattctctcactgtttttccgggctgtgtgtcaccctaaagcgagaagaatcactgtgagctgctggacatactgagcattttagacccagcatatggtctcctggtttccattgtaacagatcatgcagaggaagggaaatgagtcagccttttattatatcagtggggtactgagtaatggcatgaaatccattgtaagggatgctgcatgtcctatttcgaaagctgtgcggtgtcagaccttcttagggtagcagagaaatgagcagcaattaatctgttttgaaaagcatttcagtcagcaggtatttccagcactctaccaatcactatgtgtggcctctttgtcatctcttggtttatatgtatgaattcagatgtgatggttttgcatagatttttaccattaaatataagaaaacaccaaaaaatagaaatcactttgatggactctggctatccttggtgctccttcctattagacacagaaattattgaggtccagaatgtccactttgctttctgccaactccagggtcactgggcaccaggaattcatgacctttaaccaagctctcgttaaataggaatagaacagaggaactttgagattcttccttccaatatacgaaaatttctagtttattcctcaataaaatcctcacaaactgttcatcaagagaggtttttgttcatgccttcattttatgtcaccaagatgcttgcgactcaaagggtggtccaagcaccagcagcattggcctcacctggaaatttgataaaaaggtaaaatctcagaccccactacagcctactgaattggaacttgcattttaataagatctccgagtgatcatatgcactttgaagtgtgagatgccctgagtcatagctgtggttcccacgcacaccccacctctgggcagtgagggttgacagcttgagaatctggagggaaaattgttaaaaccataggtgtccaacctgttcacaagcatattccgattccataaatctgggctagggtccccaaggctgttaaaaaaaaaaaaaaaacaggccaggcgcggtgactcacacctgtaatcccagcactttgggaggaggccgaggcaggtggatcacttgaggtcaggagttagagatcagcctggccaacatagagaaaccccgtctctgctaaaaatacaaaaattagtctgctggtgtgcgcctataatcccagcaacttgggaggctgagacaggagaattgcttgaactcaggaggtggaggttgcggtgagtggagatcgcgccactgcactccagcctgggcgacagagcgagactctggctcaaaaaaaacaaaaacaaaaacaaaaacaaaactgtagctgactcgctcactctgaggcagcaccagatttaaggtccattcacacggatcatctacagaactagcccaggtccagccctgctgagatggagtgcttcgatttccacatcactcaagccgaagggctgagcattccttatgtgaaatttttatttaaaataattcatctatttacttattttttgaaatggagtctcactctgtcaaccaggctggagtgcaatggcacaatctcggctcactgcaacctccgcctcctgggttcaagctgattctcccacctcagcctcccaagtagctgggattacaggagtgcaccaccacacctggctaatttttgtatttttagtagagatgaggtttcaccatgttggccaggctgatctcaaactcccgacctcaagtgatctgcctaccttggcctcccaaagtgctgggattacaggcgtgagccactgcactggccaattgaaaataattcaaaataaaatgtagttaccttaggctttagctttgactttatatgtttttgttcataaaggaaatgaaaaactaagaaaagggtggcttttcctaggtactcatactcagaagtagcattctggtcaggtgcagtgcctcttgcctataattctagcattttgtgaggccaaggtaggaggatcacttgagcccaggagttggagatccacctggcaacacagtgaggccgtctctaaaaaataatttattttattttattttatttgggacagagtctcgctctgtcgcccaggctagagtgcagtggcgtgatctcagctcactgcaacctccgcctcccagttcaaacattctcccacctcagcctaccgagtatctgggactacaggcacatgccaccatgcccagctaatttttgtatttttagtagagacagggttttgccatgttgaccaggctggtctcaaactcctgacctcaggatccacccgcttcagcctcccaaagtgctgggattacaggtgtgagccatcgcacccagcctaaaaaaatgtttaaaaattagccaagtgtggtggtgtgtgcctctagtcccagctatttgagaggatgaggtgggaggattccttgagcctagcagttcaaggctgcagtgagctatgatcacaccactgctctccagactgggcaacagagtgagatcctgtcttaaaagcaaacaaacagacaaaacccagaagtagcattttctattcagccagctttcctacattgttattggtgaatgtatggcttcccagagtatatttaaaaaagaaaaccacctgattctgattctgcgattattttcattattacgggttttggagaaactagctaaaattttcatctttagatttttcttttacacagaacacatccccactagagttggatcctatccacagggcatcagacccagggaccttcgaacacgaacatctgtagagtcctttatagtgtttatagtgctttaatttatattatattatctttgaatcctcacaataatcccataagaagtaaggacatgtgtttcatagataaggaaatagaagcaaagagattatggagggcacactctaatcaatggcaggaataagagttactgttgcctagaatgcgcccttttatttgtatatagcagaaaaactggaaacatgtactgtactttctgtgtcagtggttctttggcgctcaccccaggtcaattaaatctgagtttcttgatggcaggggatcctctggcatcatccaggtaattttaatatgcagccagggtggaaaacttgagtccctgcattacaaaatcaagtaggacttatcccagcaaaacgtctctatatgcaaacctctccagggttccataaatgtaattttacgtggacatacccatacagattataaccacagcccttaaaagaagcaagcatgcctttccacagcatggttatttcagctggaccatgctgtatttactgtaggacagagataaaagcgtgaaagtaggacatctgtgttctagtcctagctctcccatcaacttgctatgtggtcttgggccaattatgtaacttctctgagccctatttcttcatatgacttctgtttctgtcttcccacacctactcagctttcgttattaagatatcaccttcagagttagactcacccagtttcttacttagtccaaactatgctgacaggtcactgagccaggacgaatcttactgtgctaaaagtgagcagcctctatgcccagaataatcttcaagatgtccacattcaagtcaagttgccaactctgcctaactccacattcaataccttattctcatcttcttccccaaactggttcctgggtttaccagttttatataattttagattttcagctgcctccttagtccagacacttagcttagctgttgtcctcatttcttacccaaaggcgcatgaaatcccattttaaccccactctaaacctccaaccataacatggtattctttgcattctaagtattgcttaagtctaggaagtctagttactgggccccacgcatcatatcagacctccttggctattgacatttgcctggctgggtcctaggtttgtcaactgtgctttggacgactggtcactttcctcaggaagcagtccctgtacttccagcttactccctctactttctctcattacctttttcaggctccctctccttacccatatctgggttcctagcatcactttcaagtcctcaaacaccactataatgccaaccaaattgaattcatctttgttctgtaaacttttcaaatctgttatgaggatgaaaagacataacaaatgtggcagcaatttgcacagttaaaacttccagacactcctgattttattaattaggctgggtttgattgttttcatttgcttaagcttgaagtcaaagttaaatcagagaatttctcatctttggagatatgtgattcttgatttacattcatgtaacaacttttatgtaggcagatacttttcggatatatctcccaagagatttatatggaatttacatctattattaacataaattggttatgctctggcattgtggctttattagccattcttctaacatttgaaaattgctattaaagactttacagttaaggtaaactctaccaatagtcttctcataagccaaaccctgtgtgattctttatatttgcattttctatttagcgtgtacagtatgtgcccggacttcatttccttagaaaaacaaggcactaggtagacttaggcggatgcaggactttaaaaatactgctgaaataatgctgagaatatttttaatagactgaagaatgttgtcttaaacatatttttatatggcagcttaaaaaaagcaaaatgtgagatttttaaatggttacaaaattaacaatcacttaattgtcataaaaagctataagaatagtgctgtaagtattgatcaccttttctggtcatattgggaacatgattgaaggtacatatgggaacaaggaagggcccagcatttcacttgagtcatctcattctctctctctctctctctctgtgtgtgtttgtgtatgtgtgtgtgtgtgcgtgtgtgtataatgagagaagtgcccaaatataatcctagttttaaaaacacacataacaaatgatagctaatggttttaggtcctgagtctttgtttcttggccaccactgagagagctgcattttgataccaatttcatgtcacctgagaagcgacttccctgagagatgccttatcacctgcaagtaaattaaaagccacaggtgtccagtaggttaacactgaccgtcttggaaatcagtgattcagaaaaggtcctgtaataaggcaaaatgtaggatctcgtcatctggtcttggaacttacaaaatgatgtttaaaatgttggttgggagtggcattgaaatactgctactatgccattttccaagaatgttgaggtcagccaaacttggtttaaaccaccttttataatataatttctatgaaacatgcattctgatttccatttcccaacagaggaactttatatattcacttaagtagatatctatctcaattcagaggggaaagcttaacatttagttagtgataggttaatcaacatcatagactactagataccttttttaaaaaaatcaggaattaaatattcttctgtttgtttttcttgtgacaggatctcactctatcacctagtctggagtgcagtggcacgatcatgggtcattgcagcctgaaaccgggctcaagcaatcctcccacctcagcctcttgagtagctagtactgcaggcatgagccaccacaccaggctaattattttattttttgttagagatggggtcttgttttgttacccaagttggtctcaaactcctggcctcaagcgatcttcctacctcagcctcccaaagtgctgggagtacaggcatgagccaccgtgcccatccaggaattaaatattcttaaggcgatcttgtctgttgcctcttgactgtgttcctttgaaagatatgaacttggactcctttatttgaaatgtaatcagccagttcctcccttttttctcttccccgtttgccaatcagagggggttacagcgcattagttgatttaatcagcatagaataatgtaaaacagtttataaggtgatgcctttctgcattcattaagcctcctgtttcacccattgaacagaaaaagagagccacattgatcagggactacttgtgataaactatctgacccacatggcctgggtggagtgtttcgtgtttaggaggataggccactgggagggagtgcttgccctcactacaccaaaggcaggctccacttctctcatccatgagatcatttagctcaaagaaagaatcagcaaaagaagcaaaagggaggaattggggcctggcatgtctacaggagtgacttgcttctcctctaccagatatgacaagaagaagtgaggtggatatttctgatttcagttatctctgaaattggtgaagtatattctgtgatgctactgacatactttttgcctttgaattttcctgtcaactctttttaaaacaacttgaatgtttcatgactatacttttgaatgcctagatgtcaacaactatacacttatgagtagaaaaaaataagttgatataagtaacgaacgtttcctggtcatagaaaaattatagtctttttatagctgagcttccagtttcttaaagtaaccttgtagagaattggtggtctggttttttaagaagagttccctaggagtagtagctacatactttctactttaattctttttttagttctagtaagagagatgcttaagctgtttttacagctatagcaagttcctggccatagcacttagaaatagactcagctacttaataaataccagttaattaaatatcttattgttcagaaaaaaaataataatttggctaaaaaatagcagaaataaatttcaggaaattctttttctgtctccttttttcctcacttgcttttgtgcaaacgtttctatgtgctttattgggcagaaaccaagaacttaatgatgcccctaattacccagcttctctcctgacagttagtttgtgtgtactttaatgataggcactatgtaactgtatttgtggatacacagatttcaattcaagttgagtacatctctattttctttttaaacatccaaaaaaaattaaaaagattatctccaggtttgatccttagaactggaggccactgatgtcagagtaagggccaaacacattagtaccgaaaggaaataatgtttggaaaatgagaatggatccataaggctaaatgatctacaaactgtgatcatttgacaaagctggaccacatgcagagctttttcttttggagttgtcctgtcccagaaagcagtgaaggatgacattgtgttagaacataggttgggacatgaagagtctggagatgtgaaaaacacattacacatccaggagagtgctaccagggatgtactagccagaagagaacaaatgatcaacactgagctttcaacaacatgaatctggctgagcgtttcataaataatccagtggacattcactacaggatagacgggcaccattcttgttttaatgcctgctggaaatataccctgtgaatctcattttttcagctgaaaaaggaatgagtggtgctttggctacatttttagcaatgaataggtattctctcaggtcagtgcattaagcaggatgttacatggaattaagcaggataatgatgcagtacatagaataaggaaatgctgactgagtcctggaaatttggaaatagactctggttaggagctcagaaatcgaaggctcagaaatggatatttaccactctcagggattttgaacctaggagtcttaggcacaaataagaagttgttaatttttctgatatattttttaacatgttcagtttggttttcagacattaggaacaaaataactggaaaaagccaaattgaagaccagagaaaactatacatttaggcaagtgaagttcagtttcacacacaaaggaataaatcatggcattttgtatgagggtaggattaaagcttttgattctatgtaatatcaaaatactgatttaagaggaagtgatttactggagtatctgtatattaatcaatgacaaacaatatggataaaaaacttttcaaatcaatcaaactgattgcagttctccatatccactaatgattttgacatttgcagatatatagaataaatacaaagttccaaatgaagcataatagttttacagagagaccaactctgtctgcattatgaactcaaagaaatgtttaatgtttaattcagagactgagagaatgttcgtgatatctgaagtaggtggtgctgctaacaaaacaatgggcagccactttgtaccgagccaagagagctcttcccatctccagccgaaacacaccctctttttctcccatcatctggtgcaggttaacacattatcacaatcttcactgtcacaattaacccctggaaaggagttgtgtcataaaaacactccataggacttcacaaatccatatggcaggcacagctgggaagacagttgcagttgataacgtagcatttcagaaatatccaaagaatctctactttgtgaagtagtgtggaatttacacatcctctcattccctcaaatcagcacatacactagggaacacctgggaaatgccaagatgcttcagttttaggtgtttgaagcccagttcttatcatttcacgcaaaccagagtatgctttttgaaaagatgaaaggacttttaaaaacaaaaggtggctgatttaaggattatgtttcttccttctccacttactgcaaactgaggtagctatgacagctctctaacattagtacccaaatatgagaaagacattcatgtaccttcttctcttgctaccctgagaatttgttcactgtctctgcaagccagcactccttctaaatgtacaactccagtttacttcaatggacacagttgtgatgaatgaaatttatgattggattctaatggattatgtaaattaggatttcaaggttaaaggaatagatttcttttaaaaagtaaaaataggagattttggcagaacctttcagataccaggccttgtcatagacagggcagatataggagtgggccaaaacaaaatgttttctcctgccatgtagcctacaggtctgctagggaggagcggggtaatgaaatcatcatactgagatgtgtgctcttggttgtgaggtgggggtgagggaaaggaaaacagggttcagtgaccatgtaaaatagaaggacatcatgtggattggggagtcagagaaggcttccttgaagaagtagttctgtggcttagatctgaaggacaagagagtagaaggaaaggaggagtattatagacagaacagctgtatgtaagtctggagtggagaggttgtcaaaagaagccaacatggcacatgagtatggacatggggaagggtgtttcagtttactgtgaaagtggtgactgaagcaatagaaagctccatttttgttcctcaaaatcttatgaaatcaatgatagccagacaccagtaagttggaaacagaaaatgttatcaaattgcctcaaatttaagttttaaaaattgagattctgggagccccgtgcagtcaatttatagaaatggtgggatgcacccattcttagctggtgaaaccaaggctgggatagaattacaaccgatgtgttaaagtcatagagttaaataaaaaataaaatatctacactatgtaaatgaataataaaataagaaatctacactatcatgatgacttgagaaaatacttagtgataaaaaaaaattacttggtgatcgagaaggaggggaaatgtcagacattgcctaaggatgcaaagcaaaacaaaatagaatgaaaatgctttggaaggaacgccttaagaaaatataagaaaatgaatggatgcatctccactgtgcttttggtcaagtacaagaaaacatggattctatgaaacaaagatgccaatgttaaaagagagttgccgccaatgcagattgaggtttgaagggagctggcaatgatgagaaatggaaatattaaaatctgcaatgcagactcagtaaaaagccaaataaacattgtagcaaattgaattagtgataagcatggctaactaggtaagtttttataaagaacataaaatgaaagtataataatcagaaagcttcataaatataaaaattaggtagtaaagttccaacccatatgtaatcaatgtaattggtaaagacaggtcatcagtgtgtatgtattgttttattgtttaatatcatcacatacttaccattccatgtgagttcatcatccttttaatagtaaaaacatattgtactttctcatgtttgagcggaagaaaaaaaattatggtattttttattttaataattaaagaagaaaggatgtttactgggagctgccacaaaaacacttggtgttttatacatggtgttacacacagttccagagatatattcaaaggatttggaaaatttttaaaaaataattccaatgacataactttacttgggttcagcatatgacctgtactcctagtagctcatatattctgttatgtttgtgtatgacacataaatttgttaaatataaacaactgggctgggcgaggtggctcacacctataatcccaacacttggggaggccaaggcaggcggatcacttgaggtcaggaaatcgagaccatcctggctaacacggtgaaaccccgtcttactaaaaagaaaaatacaaaaatttagctgggcatggtggcgggcacctgtagtcccagctactcgggaggctgaggcaggagaatcacttgatcacgggaggcagaggttgcagtaagccgagatcgccactgctctccagcctgggcaacagagcaagacttcgtctcaaaaaaagataaataaaaaataataattaaaaacatatcacaatttttgttaaaaaaataaagaaagcatagatgtaagaaataaaaatgggatatgtaccatctaagttgctagagacaataaaatcaaagaagttgtggccaggcatagtggctcacgcctgtaatcccagcactttgggaggccgaggtgggcagatcacttgaggtcaggagtttcagaccagcctggccaacatggtgaaaccccatctctactaaagatttaaaaagttagctgggcgtggtggtgcatgtttgtaatcccagctacttgggaggcttgaggcaggagaattgcttgaacccagcaggcgaagtttgcagtgagccaagatcatgccactgtactccagcctgggcaacactgcgagactccatctcaaaaaacaaacaaactacagcaacaacaaagaagctgtaatctatttaaccagagactcaaaataaagatgagcaaaaaagcatacatgaagtatagaaatatgacagatatgagtgtgtgtagcttatgaaatataaagaaatgcaacttattttaaatataagagcctcagattgagttaaaaatatgatctaaacaaaatgcaatgatacaaaatacctagactaccaacaaaacagattttaaaaagaaaaataaatgagggcagaattattagttttagaccaagcattattcaaatacaaaagcattaaattagataaaggcaaccttttttttttttttttttttttttgagactgagtctctctctgtcgcccaggctggagtgcagtggggcgatctcggctcactgccagctccgcctcccgggttcacaccattctcctgcttcagccttcccagtagctgggactacaggcgcccgccaccacgcccggctcatttttttgtatttttagtagaggcggggtttcaccgtgttagccaggatggtctcgatctcctgatctcgcgatccgcccgcctcagcctcccaaagtgctgggattacaggcatgagccacctcgcccggcagataaaggcaatttttattattaaaatacacaaaccacaatgaagacattccatttacattattttaaacaccatgaaacatagagtcatagtatataaagctaaaagtttgggaatacaaggagaaattactaatgcatatttgttacttaacttgataggtcaagtcaataaaaataagcatataaagaatttgaataatgtaataatgattggcctttcttaatgtaaacatacatacttatgtattttctctttaagcacttccataaatcctatttcaattgtttacatgttcagccaaaaaaaatttaaacaaaattgaaattatataggccaggccttattttccgccataatgcaattaaataagaaattagttataggtcaattttatacaacaccacaaattttttaaaaaccgtcccatgcaaatttcaaatcacatttctgatacctactgggtcaaagaaaagataaaacccatattaatatatttttcaaaagtgaaaaaaatgagaacaaacatatctacacttgtacaatttatgaaaagtataccctgaaacaaattaataaccttaaatttgttgtataaggaatcctggaaatcaaaatcagtaccttaagtattcacctcatgcaattcaaaggaacatagcacaaacctaggggaaatggaaagaaagaagataaaactcaaaattagtgaattagaaaacagtatatagagagacatccaagaggagctttgagatatgagatattctctccaaatctaatcaagaacaaactagagaaatacaaataggcaaaatgataagttaaaaagagcatataattttctataaaatatttaaaatcatttaaaaaactacagacaactctatgatcatttaaacatccggatgaaatgaattatctattaagaatatataaataacaaaattgaaccaagaaaatgtagaagatatgaacataccaattattatggaaggaattgaaagttgtcaagatttactctctccaagttctctggtctatacattttataaagaaaatattttaaagttttaatgtaattctcttgccaaataatttgtggcacagcaaagacaagatgaaaagctaccagtttattttatggaatgagaataatcctggcactagaacttgacaaagacagcaaaaagggaatgcctctctcttatttatgaatgttggtaacgcttacatagtgggtaatacatgtaggcactattttaaaagttttacatatattaactcatttaacccttacaaaaacctgatttaggtgttatgtattcccattttatggatgagaaaaatacctgagacattaagtaaatatggcattactcaacaattcatgaaaaaacactttaggacatgtatataaaatgagatagaagttttaaaagtacaggtaactcaaaataagccaaaataagtatttgctcaaaatataccatattacagattaaaaatacaaaaacaaaattaaaaaataaaaacataatgaagagtaaaaagatacttctggggtggggggctgggggagggatagcattaggagaaatacgtaatgtagatgatgggttgatgggtgcagcaaaccatcatggcacatatatatctatgtaacaaacctgcatgttctgcacatgtatctcaaaacttaaagtataataataaaaaagatacttctataatctgcttaatgacagccaatattatatttaacagaggacgtaaagacaaacaagaatgaaacaaggtttataattattgggtgatgatacatgaaggttcattataccatgatttctacttttgttatttgtaatatgttagaaaatatatgtaacaaaaatgttaaaagaatggtttctatggttgaatttagtgatttctaaggtggcttccagctcagctcttacatggttctctgttgttaattacctctttttccaaaaaaagcattttttgtactagcctttcggggaggaagatgtttgcattatgtggaggagtttccaccatacatggacacattggtctcctgcaaaccacgtagttcttttattgcttcttttttcatttgaaaatcattccagatactgaagttaaaatagctgtccttgctttcctgcctggagagatgggtatcactaaaaatgcctggattggcagtaatccgctttgctcctgcctggagctgttctgaatctccagtggcaggccctcacggtgttactggggcaagtgtgcagtgacgtgcatttcatctgcacacagcaacggtcagactacttggctttctgcagggaatgaaaaaatacacatataaccacccccgttcccaaatggcactgtagcctagttaagaaaattgcttgagggggagtgcattatgctaagagggctagttcattttcaggttacaaaactttaaattcaagttgacacagcttctattttcatttccatacttatctcaactggggaaatgtggtgtttgtcactaaaaaccagccagtaaaatgtagagggaagatggagagtcagtggtccgcagcctgcaagtggctgtgatctgaaatatgtcatgctttagttggtagcagataccataccaaatttgcttcccactggtagactttctccttttattttcaacaaagtcccatgtacccagcagcaatctttaacagcaaaaatgcaattaatataagtcatctcatcatgtactagcattccagatagctcataaacaattaagaatcgagtctgaattaaatgcagaggttcagggctaagtgtgttacaggaagacagagaatgctgttctgtcagttttgtgaccatgagcagtttcattcaagaaaccacatggaaggtgttccactgttaagtaccacatgtgacctctctggtttgaatatctaagtagatccataaagcttaaagtacataagctttcgtgcggctatactgaaatgtaaagaatgcgaatgaaggcacccattaaaagataaaactgggtaagactaaaattaatcctccataatcctagctttagaaactctcatctttactgtatacaggtatctttaatgtgagttattgagtaagtccaagggctcttctggtcaccctttcacatatagtctaccacattcctattccaatagaagctgggaagcattccaggataaattaattgtagaatcaatttgcttttatagagcatggatgagagaaatattgaagttttaagagtttctgttgccagacttatagaatatatttgccattcagaccctatggtttgtaaaaaaaaaaaaaaaaaaaaaattaagcattttgggtgttgaccctgggttgtgtaatttatgcatggctctggtaagctgttacctcttaatcacccaggagccccagctcttgaagcagactaatgattccctgctgactatctgctctgcttgcagttctgccttcaacacatctgtcagcaccacttcccaaggggactgtatgaaagttgcaaagtctgacatccgtacattaactactctatgactttctccattaataatggactgtcccgccgtaagctgtgagtttcctccccaacaccgaccgcttttgcttttatgtgccactaggcctgtcatcagagagacagccagagaaaagacatctggcatctgtaactcatagggggttcatgaaaactaaagcaggtagattattatctcaaatgaagttcctggaaatactgaatgatgaatgtcgtactaatggcctccttcctctagcttggtgacagcctgtaaccagttacaaaaaaaaatcttgacatacaccttcaatttttatttaagagatatagtcctaattgttatgtcaaaaccttggaaatagaggccaattattttgaaaacgttattttttccaaatctacaaaggaattgccatatgatataatagctaaaggtgttttcaagatccattttccaattaattgctttaaaaaagaattctctgaagtaaatcacaagtgcctttaagattctggctggattgtttgttaatataccttagatgcagataaaaagcgggggcaggaaagagaaaattggaagcccactgggtcagaatggcaagttttttgcttttaccaaaaaaaaaaaaagacagtgggaatcacaacagaaagaggtcggatgctgttggtgatttttgtacctctgaagcttctaaatatagaggggtttattgcttctcttgataggttccttgtcaagttactgtagaaataacttacttaccccacctggaatttagaacagggcttttaaattttcaaggactgcactgcagttgaattgaagtgaaccagatgtaagataataggggttgggaagaccctgaggaagtaaagagtacacatctcatcaataaggggcagggcattgttggttacagtgcacccaagggagtgctcttagggtcaactagacaatcaaactgacttgatttccatgggttacacttgacatctcattcacttacagaccgagcacagtgtatgcccgcagagcagtactaggccttggtcttcaatgggaatccctggaacagtccgaatagcaatctagggacttttttaaaattttttttctctattcccaagtgttatttcaagagcaaagaagttaaacttgtgtagctaagtgtagagtctcctgatttagaaggtctatgtcttaaataggagccaagatctctggtgacgttcctataggcacagcttccaaaatccccaggtcaagcctcctcattatgagtcaccacactcagggaagcccaacccaataacttctcaacagatgtgttcatttgcagtccttccagccagattcagcttaccaatccggggtcattcttataacaacatagcctgcttatgtggctgacatttcaccttaccaggtttccagggtaacaaagccagaaagttaacccaagataaagttctccatagagagagagaattttaacccgttacccactgttgtcatatgggagtataaactcagatcttttcttttcctttgttcctgcttgcccttctcctcctctttctcctcctcctccaccttcttccttcttttagaaaagctggggccggcgcggtggctcacgcctgtcatcccagcactttgggaggccgaggcgggcggatcacgaggtcaggagatcgagaccatcctggctaacacggtgaaaccccgtctctactaaaaatacaaaaattagccgggcgcggtgatgggcgcctgtagtcccagctactcgggaggctgaggcgggagaatggcgggaacccgggaggcggagcttgcagtgagccaagatcacaccactgcactccagcctgggcgacagagcgacactccgtctccaaaaaataaaaaataaaaataaaaaaataaaagctggacgactagatttttaaaaaatgtttagtctcccaatttttaagcgagactactggagtaagaatactggaccagagaacagaagacctgggttctattaatagtagtctagcaatttgctgtgtgacctccctgtgttaagtgaaaggcttgcataaggtcacctgaaaagctatttctgtgatactgttaatcttttctaattgctaaagaggtgatgcttcctgtttctctgctcattgccagggtacttgtttctcttccatcagcttttctccttctctattctgcattatcatatgaaatcaaagagtgaggaaaaaagtcaaggatcttcaaaatcatacatgactgataccaatctcatcattggactagatttctcagtgaagataatctgagggttaatgctaactctcatagaatttaagtcaaaatatctgtctttgtttgcattgcccaaagaagttggatcaaaagagttacagctgggtggattttaacttttaacccagtttttcagatgtgttaatatatagtgcaaagtttccaatgtagttagagttactacaaccctaactgaaattgcctcatactgtgacattattatatcctacaatcactcatatatctttatttttccaactctaccatcacaactgagaaaaggtaatgtggtacatttacaaataaaagaggattaggattattttcattttaatattcccactataattatctacagatttatgaagaccgagtcaagggttccatttgtagccatcaataaagagattaatttattattcccaatcgggctccaaccctcaaactatatttggccattggcttcgggatttggttatttcctcaaccctttgtgaagaaatcttttaattttttgtgggtcagaggctctttgttatatggtagaagtatagtccgtaaggaatagaaaggacgaggttgaaagtagctgtgccttgaagttattaaaaatatgtttcactcatgataacatgatcattttcaggaattttattcttcctcccttgaccacaaatattaaacgtttcaccagggaaatggctggtaagagatttagtcctaggagtaggatctaatcttttatatcacagtaagaagctgatcaaaggtgttgaaagctgactgttaaaggattaattaggtcacattgaaatatatgattttaaaacagattgaaaccagaaataaataaataaatgaagctagctgcccccatttttttcaagaacatgttattgaagagaaaatattgagccttcatcaccatttaaaatattcttaatgagcattgttgaagccattttaaggagtgtgttcttcaacataagggcaacggaaagccatgagctcttcttctaggaattgagcttatatatcactctttctttaaagagtgcaggtaatgggttgcagcagaacagggctgtgtgaagagaaccttgaaacagatgctgcaataatccaagtaagagatattggtgtctttatcttgggcagtagctgtggtggtggattctttgtgtttcccactcaacccaaacacaaaatcttccagggctccaatctaagatcaaccccatcctcttggtcactggattgcattccctctcacccactcaagaacttcactctagctatcgttttactcctctctcctgcattagatacattttctttccctgctacatcactcctacctgcatcggaacaatgtggcaacatctcctgctttaaactagtaagaaactcccactgctcaatttctatgctcctcttacggcaaaactgcaccaaagagtcatctctacatcttctctttcacggactcttaccctcagtccattgggacttttccccagaattgcacaaaagtagctctcttcagtgatgtccacaatactaaagctgatgataaattcttagttctcacagtatttgacctatcagcagcattcaatacagctgctctctctaaacttctcaaatacttgcttcttgtggcttttgggctataactctcttggtaccccctttaaatccctggatttccattttctttttttttccatttttttcttttctggcttctcatttccctgtcatctactcatattcttaaagtaaagtataagtgtcctcaggctcaagacccaggcctttatctctctgtatacttgctctctagtgatttcatccagtccaatggcttcaaatgccatctttatactgatattttataaatacctactgtcagcccctctccctcctaaatacttgacttacatatccatttcctgctcatcttctcacgtggttgtccagtaggcatctcaaaggtaatatgactaaacctgagcatttgatcttcttcctaaatcttattctcctatagttttcccagtcacaggaaagggcacttccattcatccagtggctcaagactgaaatttgggtgatagtctttatttatttatttatttccatgccaccattcaatctgtttgcaaatcctgaccactgtgccttcaaaacataccctgtatcaaaccaactctccctaccttcaaccattgcaaccccagtccaaactcccatcgtaagtggcttgatcacaagagcttcctaactggtgtccctccttctattcctgtttctccagccttttgttacataaaagccagggtgatagatagagtttgaattatttgtccctgcccaaatctcatgtttaattgtaaccccccaatgttggaggtggggcctggtgggaggtgattggatcatgggagtggatccttcacggctcagtgccgtcctcacaacagtgagttctcgtgaaatctgattgtttaaaagtatgtggcacctaccccccatctcttgctcctgcttttcaccatgtgaagtgcccgctcctgcttcaccttccaccttagtaaaagcttcctgaggcctccccagaagcggataccagcactgtgtttcctgtacagtttgcagaaccatgagccaattaagctaattttcttataaattactcagtctcaggtatttcttcatagcaatacaggaaaggcctaatacagtgactcttttaagtgtaagtcgttcacatttctccctggccaaaagccctccaaaggctttacttctcactcagaaaaaaatccaaacctctcaccttggccagaagcccccataaactggcccctggccatctgtccgtcattatgtccccacaacccccatccttctgttccatatactgtttctcaaagacatgaaacacgtccctcctagcaatggggcctttgtgagtgttgctcccatgccttgaatgtgagtcccccagatacctcgtggcttgcaaccttctttcatttcaaatctctgctcatttccaccccttcccgatatttttcaaatagtactcaccatccttctccatcgctttcactgctttgttcttaatcgcatgtagtactgtgtgacataatactcctttttgagaattatatttattgcagatttgcagaatttcacggttgtactttaaagcattttatgttaaggtcaccatagatatattgtgcagtagaactcagaagtagaatgaatatgtaatataagtctcaaggcttgcagtaggctgctttggggtttgccttctgacccttcagaagtgtgtgttcactcagctgttccggtaaggacgcctcgatggaaaagtttaaaatgtactggttcatatggactgggcaattacccatattatgtaattgagggacacctacagaaacgatctctttccccttatctatctgtattggtctgccatcatacctgcaaaattccaccattactctctcttaatggaatcaactacaattagaagtcaaccaacaatgcctgtataggaagcatatgtagagacttttagttaaaattatatggtctaatcagcaagagtctatttaagggacaataaagcagaatatggcttattttaaagcattatagaggctctctcaacccaccaccctttaactgactttctggataaacagtctcttcattccttccgtaatgcataatgactgttgcctgtggcaagctgaaggttcatggctggtaggctacgctcaggtgaatttggagcactctgttcctaggtgttgagttggacactgccaaggatgagttgtttttattcccaaaccagtttatgccagtttcacttacaattataaactttaaatattatataaactaatgaaataaaaattcaaaaggcaagagttgtcatttccgcaaaaactaggtgcaatcctttggaaaagactcaagaaaaacaagccaataaaaaaattaaaggttctacggacaattatacaagtttatttttaaataaaagacaattataattcatactctagtataattctgtactcagatcttgtcacaactcttttgtaaggaaaccaaaactgtaaatgagagttgtcaatgcatgatgaacgtagcttatgtgaaaataacaaccctagtccactgtcaactttaaaaataaataaaaggtaagagttacattgttcttacatgaaaatattgacaaataataaatttaattgcctaaaaataaattactttattagtaaataaagataagttatatataaatatataaactatatgttatgataaatttcataaaatgtttatgacatacatatggcattactttatggtttcccacttctagcaacttttaaaattaccaactaattctaggtcccaaaagtgtaggacaagcgggtttttcacatggtttgaaaacagttttcaagagtagagattgcagtttcattacagacatgttgagaacagcaaaggaggtaaaatactcagatcaatcctggaagtaaagtaaaatcagcatgcccattctacatatgaggctaacagagagtcagtgacgtggagttgagctgttttcagagaactaagatttgccttcttcaaggttcatgctgttagctttgatgctacaataccttttcaaacctcttctcctatacatctcatttagatctttcataacttggctttttcaaaatagatgtcaactaaaggcagctgagctaatcaggtattttaattaatggcatctgaattattatgacagtgtgatcatagagatgccatttttgtcttcagtaatcaacccttcttccttaagaaggtgtgggagcaggtccttgattaaatagatctgggaaatgctgaatattggattctcctcttggagattttacaatgctaataagatttggagaaatcctgtagtaaagaaatctgcccagcattttcaacccagttgatatgatttggctgtattcccagccaaatctcatcttgaattgtagttcccataatccccacatgttgtgggagaaacctggtaggaggtaattaaatcataggggcagttactctcatgctgttctcatgatagtgagtgaattctcatgagatctgatggttttataaggggctttccccttccttcgctttcattgtccttcctgccaccatgtgaagaaggacatgtttacttcccctaccaccatgattgtaagtttcctgaggcatccccagccatgcaggatggtgagtcaattaaacctctttcctttataaattacccagtctcaggtatgtctttattagcagcatgagaagagattaaaacactggttatttcccaaacatatttgtccacatgattttatcatgtatgcctctttatgttggactaaaccagtattcagtggcacacatttaaaaatattgctattctcaagtaaatttggactcctctgttcatagctgttgagttgtacactgccaagaataactgatttttattcccaaaccagtttatgccagttttacttagagattattactagggaggccgaggcaggccgatcacctgaggttgggagttcgagaccaccctgaccaacatggggaaaccccatctctactaaaaatacaaaattagctgggtgtggtggtgcatgcctataatcccagctactcaggaaggctgaggcaggagaatcgcttgaactcaagaggtggaggctgcagccgagatcgcaccactgtactccagcctggggaacaagagtgaaactcggtctcaaataaataaataaataaataagtattatataaatgaatgcctttcatatgtccattcctgttcttatatattctcagcttgttgaccacagttccctgggctgaattttgtgagtgcacccttactttgttcagctttttgtcattatcaggagagaaaaggcaaatgttgcaaaaaaaaaaaagatagacttggcagttttttctaatagctaaactgtgaccttggcacccatccccttagaggtcagtaagaggcccttgtaatcatccacaagcagagagtcagctaaagactgagatcaccccttgctcatcagatcctggttaagaagctcatgaagaggaaaaaaaagttcagactccttccacaagctaaataagtgcctctagggtcaggcatcatcaaagagggtcaactaatcaatgttcaccaagcaatttgtgatctgaagtgttgcaagaatgctaaaattatatgtatcttgtcctttacaactgaagatggcacatcaggaggtgatagctctgtgttttgatgctggctgtgactttgtgccagaccttagccccggccctgctgcaggcacacgtccttctttacaggataaccaggcaatttgtggtttactgcctgctgtgtgtgtcctgtgcaaactcacagtgtgctgacacatgactgcctagtaaatatcaggggaatattgaatgctcgtgctcagagcttttattgggaaacactttccctcatcccaccctttgctcctctcctgaatgtccaccaccatgcatcagaacagatcatttatagagatactcttagggaatgccagtctgtgccagtctgcctgtcttccctgcccacatgctcttaccggggccgacttgacacccaaaacaactcagagagttgaagtgatttgcccaagaccacacagctaacaactggcaaatgtggtattgtatctaaaatactagcacagggttgggcacagtggctgacacctgtaatcccaacacttcgggaggctgaggcaggaggactgcctgaacccaggagcctggtcaacatagcaagacctcgtctctactaagaataaaaaaaatattagctgggcatagtggcatacacctgtagtccccagctactcaggagggtcacttgagcccaggaatttgaggtttcaatgagctatgatcatgccactgcagtccagcctgggcaacagagtgagaccctgtctcaaaaaaaaaataaaatgttagcataggcttttaaatcatgtgtttttcacttacagtgaggctgagtagaaatctggggaagaattaaagcagagattccagggatatgttagggcagagcaggactcatggaaggacaagggggttggttttgttttcaatagaattgagaaggtagagtttgaaaacacatttccagaagtccccgtgttggttcccactggatgcttgttaagattatgtaatactcttcagtgctatgtctgttgtttaagtgttctgttcattgggattcttttggttgcaagtgccaaaatccaattcaaatgagcttaaataaacacgggaattttttggcataaaagtcctattaactacaactagattttagttcccaaatgatagtgttaggatctctctatcatctcttgaatttgcttttcacaagctgcctctcactgcaaggtaactcagcgggaaggagaaaatgcttcatttccagtaattttagcaaaagcttcaaaattggcctttatatgctaacttgagtcatatgcccactcttaaaccaattatggtgagtggaggatatgagggtggtgctggatagaaaatgctgattgggcagccagacgacataggtctattcctggagccagaacggagattagcctcactcgtatagcatctactaagagtcggggagaaatgattcctgattttaaaaaagattagaatgaggttaccaagtcaggagaagctaggcacccaaaacaaatgatgtctacttgtcatcttattgtaaagtagggttgcaccccaggatcccatcccgaagagttatttctagatgtgagaggtgtataccatgtacaacaagatccactgtcctggaaacatgagcaggattcaagaaacttgattctcctaaaactgtatctctgctgaatatatcccactatgtccctagtgccaagaagaatgcctgaacctaataggcccacatgaagcatttgttgaatgagtaatttaaaaccaggcagaagggatacagagtttcagtttgggattatgaaaaagttctagacatgaataatggtgatagttgcacaacattgggaatggatgtagtggcactgaactgtgcacttacaaatgattaaaatggtaaacttttatatgtattttgccacactaattttttttaaagaagaaggggaaaaccttaggcattaaggaaaacaagattttggtgacttctggatttttgctttccatttaagcttgccttagtgagtcattggacctcaacggctaggcagtcactgatgggagcagaaagaagtacttatccagcacttctccactgaagttgagcccaaacattggctgttccctactttacagaagaagatcaagggatacaataaggttgggattgatggacgtcaggaggatttgctttaggaatgcacgtgatatatgaaaagggttcagccagaattcacaaactctgttgtctcctatggccagccaggcaggtaagaatgtaaatgaatcagataatgtgagtcaggtggagatccacagccttcctttaaacaggccagtcactgctcatctcagaccagttattgccttgaagaaatacaggttcagtagtgcctggtctcatggtttttcatgagaagccgtatgtgtggaatcttatatgaaatgtttccattttggaaaatgttagcaatcacttttttttcttttttttttctgagacggagtcttgctctgtggcccagactggagtgcagtggtgcaatctcagctcactgcaagctccacctcccgagttcaagtgattctcctgcctcagcctcccgaatagctgggattacaggcacgccccaccacacccagctaatctttgtatttttagtagagaccaggtttcaccatgttggccaggctggtctcaaactcctgacctcatcatccacccacctgagtctcccaaagtgcagggattacaggcgtgagcctccgcgcctggccagcaatcactttttaaatgttctacagtagcatggtaaacagaacacagctattttccagatctttccacttacttccagtttctttccaaggatagactcttcactttttaagaaatgacagtaatgatctcatgtatttgtttatttatttttacgtttttcagtttaaggtgacacaaatggttaggacagataccatcaccccaattttactcttgaagccactgagactttacatggagggacttcagcttgcacccagatcatgcgaaaccatgttctgtgccatgtgagactttaagaggttgctttcaaaactcccccgcaggtttccttatttatcatttatctagatgaattcttcctcccttacattggagaaaacagagtttctcaatttcccatgactctctttgttagtcagatgggagagaaaagtcattacctatgcgaacctgtagaaatagatttgtgtatttttcagtaataaataaaataaccagggaatttaaatcatataatattttccatcttgccagagatggatttttttttcccctggggaaacttttaacttaagaatgtgtttcaatctccttgatgtgttggaataatcattaatgtttacagttgctgtagcaactagaaatgctggcaattgagtaggaagggagcctgagagaggaagataagctgtatcaattattgaacatctgtcaaacagttagccaatttaaagtgacagacaaaaagctagaaatcgaaggtgggtacaatgtatttgttaagttaacaacatcagttatgtattgttttgccactattacagagggataattaacacttatttgcatccacataaagggagcattttctatggcgaatatacagttgcaagtgtaaatttttatgtcataatcatcttaatccatctctcgtggatgttagtttgcagtttcaatatctatttgacagacttttgcattttttaagagcacagaagtgaaacactatgcctctgatcatatgcctctccaggcactctcctctccttatcctaaaaccactactcatttatgcagaagcagtggcctaaatattggccacacgtgtctccagtactctgtcttactctgatggcagttatcatagatcaattaaaactcctttttcctctgagtctctggcattctcaaaaccctaacacagcacctggatagccaatgccagttaggaaggactctgtagtggagtctatttgcaatccctgtctgttaatgatttctcaccttcgcttggcgttttattgtttacaaagtgttcttacttgcatagtctcatttggtcatcaaacctctaaggtgggggttgttatcccttctttacatgtgagaaaactgaggcttagaaagattaagtgatttggccaagatcacagagttagacagaagatacctacttacctactgccttttccactgcactgtaaaagaaaagatcatcaggtaaaaatccagggtgatgggtttcagtactgccctaatcacttactaactaaaaagaagaagaaaaaataataaaacaagaaagtatttaatccttctttagatagttctctctgcttctaataaaggagaactgaacagattttttcctaggatgctttcagctataatctgtaatacatgaactctaagtaaaatctagttgctaagtttctcaattacagcatttgtttattaccaggccacaccctacctcgtggctgcactcccagtttcttcccagatctcagttttttgaaagtgagagagcatattaattttataatttttgctacttctatttgttagcataataagcatgctaacactgtatacatgatcacaagatttaattttctggcctggctttgtttaatgttaagttttaatgagtcaccttttctctcttcctcattttcttttctggaaagcaggattattagctccaagagatgagtcaaatgaagtaacataaatggaaataactttaggaaaataaaatactgtctatgataagatattagggtagctttattccttataaattctgacctgatctgataatattaagtagatgatgatttagaatgggtcttcagaataaatttaaaggaacatgtaagtcatcaaatgattctattcaccatctttgccttatcaacaataataataataaacattaacatttattgagtgctaccatgtgctcgacactgtgctgattataagtagcaatttggctacagtattgcacgtgatcccccaaccctcctatggtgtgttattattatctccatttttcagatgagaaaattgagtcttagatatgttaagtaactttccatgctcacaaagtagtggtaaaccaaggtttcaagaccatgtacgtctaaccccaagttctagagtagatacttgaccggttataaataatacttcacacacccaaggtaaagatatttattttaaaatagaacaaagcatggtcttgcctagatgtcccataaagagctgtaatcatcagatgcccacttttttcctttaatttttcttgaagctgacttttttcttgcaagtctttgtgttattgtcttcaaagaattacaagagtcattgggaagaatccaccatttctaagaaccagtttttacgcagaactattttaagtggtaccagatggataggaaattagtatacaactatttttcaagtggggcttaggaacaatggtaagaaggggccattagtaaatggaggaaggtaaaataagtctctaaggagaaaaagaaatgacaagggtttatattatattaagaaatttttcagatactttttatcacaggggacggaaaaaaaaaaagaacagtgtccactagggagttttttataaaatgaatttattgtttttgttttgttttgttttgtttttgagacggagtctcactctgtcgcccaggctggagtgcagtggtgcgatctcggctcactgcaagctccgcctcccgggttcaagcgattctcctgcctcagcctcccaagtagctgaggctacaggtgcccacgaccacgcccagctcatttttgaatttttagtagagatggagtttcaccacattggccaggctggtcttgaactcctgaccttgtgatctgcccacctcagcctcccaaagtgctaggattgcagccatgagctactgtgtctggcctaatttattgattttttttcaaagcatattacctgaatagaatatttcttctgagtagattttcttgaggaattcaaccaccacatgtactcacttctctgcctgtcagttctgagtcctagtttcttctcccagaccagcttgtcaaaaatacattagacatgagcatggacactttgcgctcgctctctgttttggcgtcttgaaaccagaggaaaaaagacctgtttgttcagtttgaattttaaaaatctctgattggctgatttaagtcatgtgatcctcactgaaccaatcactgtgtcctgaggtatgattggtctcctgtgactcactcccatctctatgctggccttgggggaatgatgactgccgttccccaaaaaccaattgacgaagcattgctaagaagatgaaaagtgcctttctggcaaacctggtaataaagccaaactcatagatgattaatctttcatctagtcctcttcactgcacctcaaggcagaaccggaccattgcagccagtgatggtcttttttgtttttaaaggtccaaataaaagaacaaaatacctttattttgaaaaggatagttccattctttacagaccaacagaccgaatgcttttgttattggtttcacaggagcattagcaagacgcagggaagcggggaaaagcatcttgggccataatgaaaactggcattttatttttctttcttcttctttttttttttttttttttttgagacagagttttgctcttgttgcccaggctggagtgcagtggcacaatctcggctcattgcaaacttcacctccccggttcaagagattttcctgcctcagcctcccaattagttgggattacaggcgcctgccaccacgcctggctaatttttgtatttttggtagagacggggtttctccatgttggccgggctggtctcgatctcctgacctcaagtgatccgcctgcctctgcctcccaaagtgctggcattacaagcatgagccaccctgcccggctgaaaattggtattttcttagcacatttgattaagggttaatttgtgctcgtgatttaaatgtcagttgtctgaattttagatcacaagtttaatcaaggagaatgtggaattgtttaataatttggtgaaaaggttgtgtgttgttaacttgtgtgggagttgattatattacttgaaagcttgctcagtcagtcatattactgcttgaagccttaaagaaagtaaataattagagttaaactgacattttccaccattcaacatttttttcattattcctgagaatccattttagttcccatattgaatcctcttttttctttcttcacagaaattgcttagcttaaagtaagaagacagattttgattatgctgtgagaaaaagcaaaatttctattaattatgatttgtccagtcaaaattttcctacgaaatatatttaagtgctgatggtacgagtgacccgtacaatactgatatttcaggatttaactggtcacctagttccctgaaattctcagtactcctgaatgttgctatggggttaaatactgtggcatacaaaagaaaacaaggttgtcctgatccctaccacagtccccctcaaccacaggcctggcacatcagtcagggtaatcactgctggactgccatgtcattggcttagttaagctggaggtttcagttgcagtggctcctggcataggaaaagaaatctttgtcatggtctcaagagatgtctgttttaatcccaaatctaattccactgatagtctttgtggtcttggaatagcttatgtaattttctatatctcactttccctgtctctccaatggaactaatccttattctacttatttctaaaaattgtcagaggcaccaaatgagataatggatataaaagtgttttgaaaatgtaaagaagtaggaaagttgtggttctgctgatggagatggaggcttacttagtaaggtgaacaaaagtatctggctcactggatccagtttaactttccttgtgcatagagatgtcttattcagtccaggtgttcctgtcacctttgagtaactgtgatctgacctgtgtccaggtcacacgggtgtcatctggtaactctagttttcatcaacatatgtcatttagcgtaagtcacatcaggtggactaacttcgctgctgcatgctttcctttctgcctttactgagtccttctcattcttggccagtcagtcatattttctttctgtcttagtaaactcagcaaaactgcaccagagtcagaaataaatggaaagggaaggatttttaacgaaaggggctcactcattctgacttaaaacatgtattttgatagtccagaggttttttttgttgttattttttccctcctctgatttcagtgaatttgatttaccattaatggtctgatgaaagagatatactttcttatttacaagcgacttctttctcaactaacactttgggcctggagttcagcaataatactgttgctccaggaaacttctggcatttggaattccacttcgattcaactaatgcttagtaagttgatttcacaaaagtaaagtgtatgttctctggccatatgtattcttgtccacaagcagtcttcaagcctggaagatggaggagagatgagcaactgaactattctaatacagttacaaacaaatttcaacgtgtgaaataatgggctggttgctacgaggcaaaaaagaaacaaacacttattttgttgttgaggagagaccacatgtaattttcctggtcaggaaatggctttttgcaaaaggtggtggctgagataagtaaagcagggaaacacgtcctgagaagagagtgcacaagccttgtcagagggactgaaaagcacccggcacacaaggggatcagtgactatttttccactataccttaagcaacccttcttagcagtataaacctttcttaaaatacaatttcgtggggaagtgcaaatttcaaaaacagagctctctgcttaaagcccagatggacgggcacagccctcccactgtgtcttctctttgcagctacaagcgacccctgcaggaatactatgtattgtatgaatccattaatcacggatgcccttactcagcctccctaaagttttgcaactcctcgcttgagggatcctccccaagagtatacattaacaaagagtaaagagtagaaagctaaaattaagtaacttggggtcctgttatggaaggatttgaatgtgagctggatgcattttactttatccaggaggcagtgggactcacagaggatttgtgtgggaaggaaggacatgactcaaagctgccctttggtaggattaatctgacagcgttgtatgggttggcctgcagtggcactgaacctgacacaggcaaaagagcaggatgttcttaggccagtgacagatgacggtgagacaaaaaacctctatggaattcgaatccacaggacttggatgctgattttctccccagcaatgggacccacactccttcctagagagaacctgggatcaaaccacagggcttgtatgaagcgggcataagtgtggagctgaaagagttgtatcatgtgattttgttctgttctcctgctacttgagaaaaagccatattctttctgagactgggcattgaactttgatagttgtctctttagcttttatgtgctttccacattatctgaaagtattctatacttggctgtcaaagggtatccatgcttcaagggattaacacttttaaaatgagctttgtgtgtttgagctctttgtaaaatatggtgatacctttgatttcttaaaataccaaatttttaacaaatagctgaaagaaacattctttatcccccatgaacagtgtttccatctgcccatcatagtccacttcagctgcatctctctgccatggctttactggtttgatggtttgatcacactgaacagactgggccatctattttttgttttgtttttttgagacatagtcttgctctgttggccaggctggagtaaagtggtgcgattatggttcactgccgccttgacctcctgggcgcaagcgatcctcccacctcagcctctccagactcctgagtagctgcgactacaggtgtgaaccaccatacccagctaattttttatttttgtagagatgtggtcttattatgttgcccatgctagtctgggccattctttgtcacagtcaggcaagggtctaatgtcagttctgtatgatttcagcaccccacttttatcccatcaaaatactcatattagcttatatttgttttcttcagcaccattcttataccaacaaaagtatgcaactaagggtcagttccatttatttatctttgtgtctgtatcctaaagcaggggctacaacctaaattgcctatagattcatataggactggtatatggagtagggaatggtagaggctatggcaaactggagactgagtgcctgttcctcagtggaaagctgctattcacctttgacaatcatttgcctgatggaatgagagcctaatgtatccaaaccttttaaaacagtgtttctcagagtgtggtcttcaggccgacagcatcagcagcacctagaaacttgcaattcttgtccctccctgttccacctccagaataagaaattccaagagtgagatccagccttttgtgttgtaacaagcctttccagtgattgtgatgcttactcaaatttgagaaccacttgttatagtggacattgtgttgtatcactcagactgcttttgaggactgatatttgaggactatgtttgtttcaagaaaagcccaatatcaaggccaggcacagtggctcacacctgtaatcccagtactttgggaggctgtgatgggcagatcacttgaggtcagtagttcacggcaagcttggccaaaatggtgaaaccctgtctttaccaaaaaatacaaaaattagccaggcacagtggtgcacgcctgtggtcccacttgggaggccgagatgggagaatcacttgaacccaggtggtggaggctgcaccccggcactccagcctgagtgacagagtgagaccctgtctcagaaaaaaaaaaagaaaaagaaaaagaaaaacccaatatcaagatatatatttgatttttagttttttattatttatttttaattgacaaataaacattgcatatatttatggcatacaacattttaaaattcgtatacattatggattggctaaatcatgctcattaacatgttcattacctcacataccattttttctatggcaagaactttgaaaatttactctcagcaattttcaagaatagaatacattattagtaactatactcaccatgttgtacaatagctctcttgaacttattccttctgtctgactgaaattatttattctttgaccaacattcctccaacctccctgctccccagctagcttctggtaatcacaattctactctctgtttctatgtgttcaacgttttgtgattccacatgtgagtgagatcatgcactgcttgtctttctgtgcctggcttatttcactttgcataatgtcctccaggttcatccatgttgttgcaaataacagtattttattatttttatggctagatactattccactgtgtatatatatcacattttcttcattcattcatccactgatggacacttagttgattccatatcttggctattgtgactagtgctacaataaacatgagagtgcagatacgtctcttcaacatttcattgcctttggattttcagtttcataatatagggaaactataacagacacatccacttgtcagtctcagtctgtcctgtgcactgtcactcttcagcctccactccagtctgaacatgctaacaaaaaggatgctttcctggtttttttttttttttaatgacttcttcccttgcaggatgcaaagtttactgactccagatctaggcaatatttctcaaactttctcactgatacagttctgagagcagaggagagacagggaatgcagaattatatgctgaagccattcactgccaaatacaagattttgttgaagcctttccatttgcctttaaaaatcatataagttgtatgtcctattttgtcatatactcatatttggcttattgtctaaacaatgagttaaattactttcaagttaaattccgtaacttccacccacaatttcttaaagaaaatctgcaccctagaaaaatgctcaatttacccccaaaaaatagaggcaagaaaataagaagttacatgtaagagggggaagttataagtcatactcaaacatattcaagagccatatacctgaccagaaaatgcaccttttgccatcttgcttttccatacctccactgccacatctgagcgagtaaatagcatgtactaaaaatatcttgaacaaagcgagtagtctcttagttggaaggcttatttttagaaatacctggcacaaggttggatgagatttagtactaggccttatctaatccttgcctcatatgggcaccatttcatttctccaaaatcagtactgcaaagacggtgaaaagctttcactttatgtgccaacacaaattgattggaggtaattgcctgaaacactgtactgagaatgattctcagtctgtgtctggcagagtcaattataaatgttagccatgggtgtaggagtggcgactggtggtccaagtgacagatatctgtcatccctgctctactcagcactaataaaaaatgaaagcagtgtctgaaccctggatggtcctgctcattgcttgggacctgtctaaaccaagttctctggaccacagaatattcctaataggggtcctgacagctacagtcatgatttcagcaacctaagctgcaaagggtcattaccgtcattataggtttaaatacaaattagtctgtcttctaattaatagaggtacaatatctctcccatttccacaccttcagatctcaactcatctaagacactgcccctccactcttgtttcccaagcattgttcactggatgacagctcacatatgactttatatttatcattctgtgtcttagtataattaaaatgtcatccagaggccccctctctcagaatccaaagtctattggtcattctcttcttgagagagctctttcatatgacatgagtggttttggtttcttctgaaaccaaacactcttgccttctcctgctacctgtttattgtgcacaatcatcagtgctatttaattcttgcagttcctggtataattcttactttctcagggaaatttttgggttgctcgcaatttctaacatttttttttcgcaaaggtcagagaaagacaaggtatcaatccatttacgaaaagataatttttgttgaaaaaaatgccaaaagaaactctaagaatttacattaatatgtttggtgatcggtgtaactcttggtttaggcagggaaggtattcttttaattatcctatttttcagatgagaaaactgaggaatagaaattactttcctgctgattaaatcccgaagccaagactcaattcatgtctcttgacaccaattccagagatctttccatggacttatgccatttttccctttgctcagcacactgataactaattccaacccctgtctttgtaactgctctccagcacacctctccatctcagcactgagctcagtgcttttgcaaacaactgatgctttgtaaatatttgaccaacaaaggaaccaatgaatacattcattttacccatttcatttgtagaaatcacttaaaatacacttttcacatctactttcttagaattatatatccatttaaattcaacctcacaaacactgtgtaaaaaacaggatacatattgataaaactatctaaaggtaaggggactctatcatgctgttaaaatcatttattaaagccaaaatttgttataatgcaaagactaccattcatgtctcctgacttaactctaatatcttccttctacaaaacacaacgcagcttaaatcaaataaataagagtgtgtgtgtgtgcacgtgtgtgttccagttcttgaccttgccagtaactacccttgtgattcctagcaagttactgggtttccttggatctttctttccttatttgtcaaatgagcatgttggatttgatgatctacatatagaatgtacggaatgatgaaagagactgagacatcatgtaatcccactcccccaatttatagataaggaaaactgatttcttctggctccaaaatacatttttaaaggaacatatggcttcctaacagaatcagctcttctgaatactggggctaccccacagtcccatccctgccacttgtcaaatgtgtgatcatgatccactcatacagtttctctagacttcagtttcctgatatgtaaaattgaaaaagttggactaagagccctttcaggtttaaaactttgaggttaagaaaggcatctttgaaaactgacatctttgccactactgggatatgactcagaacataacgaagcataatatagctctagaaataaattggtgtcaagaacaattaaagagcaaccatccagagaattctgattgatcatttgtgtaatctgttcaatgagtacctggatttgaaaattgcttgattggtgtcttcttttaaaaataagagccatacatcatttgttgttggcttagagatacagaaaaaagaaccaattaagtgagcttcagagttaatttccaatagatttggatgctgcaaaccaaaaaaaccattgctaggcctttcttctttaatgagtatcacaatacaactagcctcagtatttttcagttgagccccagaagtttcacaatccatttaatatgttgcattccaagtatctgtttactcagttgttaaaaattgccaatgggacagaaactgtctgtcacttccagagcaattagtgtgtgaaaacttatcaaaagaaatctgtcaagtttgagtaagtataaatattgcatgaaagtccctaaggaaatcaaactgagtaggatacacttttgcgagttgcagcacagaaaagtttattttgttttatttacttggctttatttttcagaatgttgatagtgcttcatgtaacccaatggattaatgttttgctctgataaaaacagattttggttcttaagggaaatctcaattgtatattgagcgatataaaaataccagatcttggtttcaaatatgaagagctcttactttgtcctagatgggacactggaatgagagttaagctagaacgagtaggttatagtccgcctcacccctttttggtgctccagcctaaccctttctagacctcagaattttcttatctttaaaatgaagaaataggacaagcgatttgttgggtatgttttagttgtactacactttttgcctgctttgatgtctacattctcattacattatattcctcctgctccttcctgattgccctgaagagataaacaaataaaaatacaatattccaggtggtgatatttgatcgtgaaaaaaactaagttaatatcttggtgagagatttcccctgttttaggagcttagtgcttaggccaacatgttctcaccagtacaccagccaagacttttctgctgaccttcccacttcaggactccacagtatttacaaatgtcagatgttgaaccatgttggttaggttccttagcatcttctgtttgaggctcttcttggcatctatggtttcttcttttttttttttttttttttcagcataagaaatggttacgctgttatattgttattacaattggggaaacattacaactttaattcaatatttgttgttgttttctgttgttctatttaatattaatgattttgtagaaactgaagtaatacagttaataatccgtatattttacttattgttttttgaattgaactaattggtacagcgtttcccaaactaggttttttgagctgtgggggttagatggttgtggtggtggtaattccatgagcaaataagtttggatgcttaaacactctctaaggagtttcaaggacattggcatgacaaaatctcttgccagtcctgaaagaaaaaagttgaaactccgttttactttgtttaatccagtacttctcaaagtaatttgatcatgtaaccctttgagttttagggaggtgggggtagaaaacaaagaattaatcatcaaagaccactgtttaggaaatgctgcaggaggcacttccggttgtttgcatctctcactaagttactttagtcacaaaagcagtgaaaccaaaggaatcaacctatttttaattagatcaaatagcatgttaattgaattttcaaaaaagtttttacttctataatgattaacctgttgaagtgcaacaccaataataactaacatctgtacagccctttagagaattcaaagtgctttcacataatcggttgctcaccacttacctgcatcacatttaaaattgtcctcattttatggaccaagaagctgaacatgaagtttaaatggcttccctaatataacgcagatttgaactttagtcttactttgttgttgttgttgttcctctccaattagaaaaagaatgaagcagatgccattttcccaatatcgactttctggttgctaaatgagcctcccgcagaattcagagagccttgcagccagtagctactactgagagttctgaaaaatattgcagggaaaaaaaaatcatttcctagccaggcgcggtggctcacacctgtaatcccagcactttgtggggccgaggagggcagatcacctgaggtcaggagttcgagaccagcctggccaacatggtgaaaccctgtctctactaaaaatacaaaaattagccaagcgtcgtggtgggcacctgtagtcccagctacttgggaggctgagacaggagaattgcttgaacccaggaggcagaggttgcagtgagccaagatcgtgccactgcactccagcctgggcaacaaaaagcaaaactccatctcaaaaaaaaaaaaaaagtttccggtatttgattccaactctccttggagaaatgtgagttgattagtattgtgctggtaaattacattctaacttccatcatgtgactttggaggtgctaatttatacttaaaactctcttataaataattaggggataggtaatcttctcattttgcataggagaaagcttaggtgctgatagattactaggtttgcttgaaactcacctgttgagtatgtaaggactgcattgcgatgctgtttgttgaaagcctgccatacgggatagtacttcttcacaatgtattataggggcttttcctcccccagattttagtttcttgaggaagctttctggaaagcacttgtatatttacactgagtatcctcttgacaccagcatggggttacttgtaatgacatgcacatgcgtaaataaaatgattagccattctcatataaacataattatatctttctaaaataatacatgtggaaatgttataatccagtgataaagggaaagcaatgtgcatgacccctcctttgtgcgtaaacagtggatttaaggcagaatatgtttcctgttgcacattcagttgttaaggtcaagtacaattgggacacattgaaggattacagtacaaaaaatgccttttacagtaattagcgttctctctacaaaactgaagtgacctttctgctattttccaaggacactttatacatttagactttagctcaggatcatatgaaaaagtgacatataagaactcagtcaactagttctgaaaccagaggccccattgcatttagttgttcccttaccctcccctcaacaaagtaatttttgaagataaagtgggacatgttggctactcagtgccagtagctagtatatcacttctccagctttggacaaatctggaaattacactttaaagagaggaatcgtggaatgcctggagctgaagcagtttgatttccttggagcacaatagttcactgcagcaaatcatttatactcactgtcatttagtggtcttctctgaaatggaaagcatgggctcatgtggtccttcataaaacatttacctaattcttataaaagttagaactttcaaaggaacatttttgatacaactgcctatgaaattcatcccactggtcttatgggataagggtgtgtgaaaatgttgctgttttatcactatctcatatccactccctcgtggatctaattttttttaatatggatgtatatttgtggaatcagtcaactagtcagtcagtgtatacttaatgagtgtttgccacagtgttaaactgctctcttactaaaatgatggaaaagtattcaacctcacaagtgagaagaaaaaatttgagttgatagtaggaggcattgggagaagactgcattgacactcaggaattattctgtttctaactagagctaagaatttgaataagttactctgttcctaggtgcccgtttctcagttaatggaaataaaactatcaaatatattggaaagcataaagtgctatgcaagtatggggcattatgatgtaatataatgattattatctataaaacaaaagaaatgatctaaatagtttccagggtggcttccagcattactatatcaagattataggcaccctgggtctgtaatttgagcattactcaatacatgttacatagtgcctgacacctgattagcaaactataaatgcttagcccttgacttaaagaggttggacatcgcttaatcagctatcagtgtatcttttacttctctggaaataaaaccttattgactgatagtagaaaggctggtaaaatgccacgggggactgtgattacttcctatctgtatttagtgggctgaaaaagagtcattggacaacaatgtatacatttttaacctgatcatttctttcatgaaaacagtagagttccagtgccaaaagacatatttgtaatgaagatttttttcctttcagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggtgagttttcaagtaattttgttaattttgtttctgcaatcacaggatgaatgtggaggtatgttatgttgttggcacatgaagctttgttgtctaaattaaatgtaagaaaagtttactgcagcctatatttggtacccatattttctccacttgtgtaagagataaacccatgaatccattttggaaaactaattagaaatctaattgctaatctcaacaggaatagaatgaggatttaggtgaatataaataacaaaggaaggtatttcttgtttctctcccacttaaactgtatacacagtcagaatgaagtgaaaggttgaacaattagctcattaatcaattctgtgtaatttagtattctgtgtccaattatccaaataacttctggatgtacagtactgaacgcatagttcccaccacagtgaaatgtagacataacaaggcttgtttgagacagaaattttaattccccacactattagaatatttcaagaaaatatatgaaattcatatattcttaattacctaaatgacttaacaatgtgtagtaaaaatcactgtgtactttgtaaagacggccgtgtatgccagactctaggagtaccatgccctttcccaccacgggtttttatatatgctgttccctcttcttgaaatgctcctcctttccttagtcccatcctctcagcttctcccttggataaactgatactggttcttccagtttctttaaagatgtcactgtttccaggaagccatctctgcttgctcaccctgccacccaaccatgctgcgtcaggtacctactgtatcgagtctacgaccataccccaaaagatctcataattctgcatcacagttgtctgtgttcttcactgtctgtcttactagcaatttgcctttttaaagcatatgtagtaccttattcacagccacctctgctgcacctggtttcgcaactggtacatcgaagattctcaataaatatttgttgaataaattcaaacaaagacataattaagcccttcaacaagggctgatatcatgatttaagcagtcgttgtagacatgttcaggtttctattctttttaaatccttttactgtctagtacacattcagatcttctattatgaacaggaatgacgagacccatcacacaagtgaggataccatcagccaaaaacattaataggaaacatctacttgacacttaatatgtgcctagtcactgtgcacagaactatatgtgaattatctcatttaaatctcaatcaattatatgataaacattttcttttgcagacggggaaactggggctcagccacatttgttaaaaattaatggctccaagatttccacccagcacccatgtcttactgactccagagcctgatatcttaaaccctcacagtgcttcgttgcattatactgtaacacctcttatctgaatttatacaagaaaaacttgacaaatgcaagacgggaactcagatttctattccccaagtttgttactctttccctgtgttttgtcagtgaactttgtgcccaagtgatgctctgaacctgaaccttccagaacaaagtattttatatactaagcagctctgaagagagggtctgagcatcctttctacatagactacactgtggaatttttgagcaaataatttagattttaaccattcatttattcatccatttaacatacatttatttagaacttcctgtgtgacagccactatgctgagtgctggtgaacaggaggctcttgcattctcctgggggatgcagacacaaagaaacaagcaaacataaacaaaaccaaaatcctattattttagatgccagtaaaccagtatgataaaatagcagctctgtggtgggtttggggggtggtgggtgtctactttagacagccatggaaagcctttctaaggaggggacatttgagctgagatctgaatagcaagaaaccggccctcttaagatcagagggcagagctttccaggctgagttaacatcatatgcaaaagccctgaggcctgaaaaaaagcactcagcatgttcagaaaacacgaagaacagttgagcgtggttgaagcatagtgagcaggtaggagggtggatagaattaaggttaaaagagagttttaatcttaattagaaataggagaaattagcagattttacttcgagtgcagcgagaagccgttagcgaattgtatgcaaaagagtgatttatgtttttaagaagattgcttagctgctatgtggaaaacggactttcagaaaacaatagtgaaaactggaaatccaatcagaatactactgcaattaattcagttgggaaatgatggggggtgaaactagggggtaacagcagagaaggagagaaatggattcaggatatagtttgctggtaaagctgcgagaacctgatcattccttaaatgtgggagacagtggaagagaaaatcaaggatgacacataggtttctggcatagcagctgagtgtatgggaatgccctttactgaaatggttttactgcacaggttagcaaaggaaaaatcaagaatactattttaaacattatttgtaaaaccaaatacataacttctcccttggcaacaggaggaattatttgttttgtgcttttttggccatctttctataataacattcatctggtatattcatatttgtccgcttgccttccccaccttgctcacattatgatcaaggaaagatcagcgttttcatccgactttgtactgcgctccagcacggtgcttgccacatggcaaatgttaaattaatatgttggattaagctacattatattcaataaaactgaaaattcttatcagcttaaagagaaaagtaagtaaggtactagctctgtcaaaagctatcagtgctatctctccagactgacagatgaagaaagtttcaaaagatatgctccagtggcattttgtaagaaatctcttaaaaatacagcccctgtggcttctacccaaatgcacttaggccagaatatctgttcagtggtattatctgttttggtctatcaagtcatggatgtaattacatattgactttgatatactgtgacatagccagggacagacgtcacacagaactgcctcttcaaaaaacaagaaacaaacattcaggaacacaagcactccagaatcatcatgtacacttcaaactggcaacaactctgccttttccctggcttttagatttatcttgatttgtctggtatatcttcatagagatgacaaatgttttgtattaaaatattttatcacaaagttagcagactaaagatctcattcttcagccattaatgcccactcattcttaatttccatgagtgttgcatggtgaaaattcatgtcttttccatttacactggagtatataaaatggacactcaaactgtgttactaagcacaaaataggttattaaattagctgttttctgaagatgagagaaaaggggaaatacaaatcaagaagagattgcaaaataaagaggacattcttgttaaaatctattctgtgacagtaaaatcaatgaaattctctctcctcaagatctgggatttggtgactgtatattagactggtaagtgcaaggtgagtatagaatttgtacaatcattttgatgattgaagcacactcaaaatttcacatcctctgtctgcctcagaaaagggaaaaaaagcaaggcaaaggagtttgaagcctgagctgaactaattgctagacttgtcatttactttgctaagagcacatgtagctggcagaactgtatttccccaatattcagcttgtttcttgggcatttcagctaagcagtctggactatgatttcttatttgtacccaaaaggccacagtgagtcataaaagttgaacagtgaaccttggctcagttcctaatacaaatgaggtgtgatgagtctcatgtctgttcactgaccatttaccactcacccgagtcctgcaaaaccctggggctccctgttcccttttccccagctcttcacatggctcactccttcctacatctcagatgatgtctcctatgtggggccaggaggtaaggacacaagccatgaggatcccgaagccaagcagtccaggcagagttcagccccaccatttattagccacgtggctttgaatgtgtcagtttaacctcattgtacttagttttctcatcagtaagataagggtaacaacatctacctcagatagttattttatgtgtcataattgaaagtactttgaacagtgacaaaacagaagtatatcatcaataactttcttacctaaaatatgctcaacaaattatatttttaaaagacagattactatagtgtatagatcatattattcttcttttttaaaatagtggataatgacagggaaaagtggaataatactctccaaagtgactaacgatgttaaactctaaagggtttaacttttagtggtaaattttgatttatttttttctttttgcttgtcattatttttctcacttttctaaaacatagagttttcaaatttttagaacattgtttgataaagattattggacctaataggcacttagagatcatgcaattttatatctttattttttgagaaacaagggaactgaagatcagagaattcggataagaaaaatggcatcaggacagattcctggtccctgatcatcatattatttcactgaggttcagaaaaggctgtttgggctctagatttagacatttgcttcgtttcttttgctttataatttttgataattttatagtgagaattatttcaaataactatattactttgcagtattcacttctgggacacataaaaatatgagttggtagatatatgtgagaacagattttatcagagtttatagttatttatccagatatttttaaatctgctttgagaagataactgatttgggaaagtacacctgttgcttaggaaccatgagagggagaaagtataattgggaagaatacatcatggttattattagtacaggtactaaagtagtccattgatccttattagcacagctgttggttataaatagtgatgagcctgctctgttatatgcttcctgcacagatctcaaagagttatccctaaatttccataaacaaaggtaacagaccactcatatagcataactactaaagaaatagtagccttcgatgataatcatattggctcttctgtctttagccacttacatggctctctctaaaatggcttaagatgaaaagaattagcagagattaggacagtcttgagaagatgagataatgtctgttacactgtttatgcacattacattacacacacagggaaatcatttagcatgaaaattcattgtttagcctttgcctttttttctgttttcctggagactggttggggactggtttggaaggtttggaaggttttttttttgttttgttttgttttttaaattttgcttattagaacaaagatgaatgttgagcaatttatagcctgtgtctgtctgataggtccatgcattgcacagtaattgttaaatatttttgaatattaacccgaattggaactccacatagaagagatgctacaaaacaaggaacaatgagattatcctatcttagagtttcaaattctctctttctctgtactctgtctctctttccctttctctcctccatttctatatttacatacattgttaatcatatacattttggatataggtatgtatatataaaccagatatattgtctttgggggttcaaatgtaaagttaacttctctaaatgtttattatacttcagtataaaattaaaatgtttaaaatgtttatgtatgttctcaaatataactgaaatacctgaccatgttttcccaagtcctcactcatttttcacagcctaatttagccatgaaaaacagtgaataagagcagcattgaagtatttaatcttctcatcttaaatcaagctttcacccagtaggaaaaagcccaaacgatgacctcagcatccttcagtttcacaacttttagtcatgtccaggactaaagtcaagagggcaagtaaagggattctggagtatagtcccagacgtaccagcagctctcataagacaaatcattaccatttctttggtccttagtcttctcagctatgcaaaatgggtgatttataataagttctatctaaagtttcttcttcttgtcttcaaggattccagtcacaactttctagcctacttaactccaatctcaacatttgcccaagccagataatatcaggtttaacagacagatgctgctcattgaatccgatttctcatcaatgctgacagctgatccctgcagaaaactaggtgcattcagtctttcaggccacagtgcgccattttgtgagccttcacctctgtgaccattatacctcctagtggctcagaagactacattccccacaaacttctaaatttaagaccaaaggagacctttaaaatagaaagcagaaaactaaaagattctgaaatattcttgttgcagcatcatgcatcctccattatggtcttgccaactggtcactgtaaactttcctaatactgctccatgctacattagatcctcaactgggcatcaacagccactatttttcttcatgaaaagggagctttatttgtaggccacttaattaacctagtgggtttttgaacccagtcatttaggagatctcttctagattggagacgtgatctacaaccctttattgaagacctggcatttagacaggcaacaggtagagatatgccttccacttagacataattttatattatttaagatctagagtttataccaaaacactgctttattttactctcacttctaattgcaacctttgtgtggttttgtcacagcaatcatgtcttgattttaattctctgacaacatcgcagttgaggatctgtgggcgtaaaacatgttttatgaggagaacatctaaatgactaaaggatgtgagatattttgctaaactgccattgctaatctgatttaatagcatcttaatggctctgtgtattttgaaggtttgacaagcttaggaacttggcagtcatctttagacctctagcatagccaattccatttcaggtccatgggggctaaaggtcttggatggccatttggctactcagttagaaagcatctgttaagtgctcgttgtgtgtggcacactatgaaataaaaagacatgatttcagcctgtgggaacctacagtcttagagaattccaagttaatgaagggtctaaagtttcattctttactggaattattgaattgagttctgaataatacatttatagagggacttgaaatgaaagagggaagcagaggtgtttagcctagaattgagttgacttggggcattcttttgatcatgcatttaaccaacgaatactcattgagtatctgttctctacttgtctctagagatgcaaaagtccttctctgccctcatggattatagcctggctgagaagcctaattgcagttagaagcaggagtggggccatactcaggggagaatagagaattaaagcagattcacttcagtttcaattttggtaagaactaccttggagcagtgaagtgtacagggaaattaggtgtagaatcacagcttaagggtgaagaaaccgggcctggtcttgggaatcaacccaaacttccatgaagagtcagacaatctaagataaaataaataattccaggcagcaggcagattatttgttttaactaggaattggcaaactctttcccacaggccaaccttgcctgtggcctgtttctgtaaataatttttctatagaaatgttgggtattcttggctaattcctagattctctatcatttttgctgttacagtaagttgtgcttatccgtttgtttttgtttgtttgttttttgagatagagtctgtctctgtcacccaggctggaatgcagtggtgcgatgtcagctcactgcaacctctgcctcccaggttcaagcaattctcttgccccagcctcccgagtagctgggattacaggcatgtaccaccatacccagctaatttttgtatttttagtagagacagggtctcaccatgttagccaggctggtctcgaacttctgacctcaagtgatcctccaatctcggcctcccaaactgctgggattacagatgtgagctaccatgcccggacagttgtatcttatctttaatcacattatctaattagttgttgcttatatatggaaggtactgttattcttgtgattcagtatttggcaagcttgctgaaatttcttgtagttctaataatttgtctgttgattctattgattctctcaaactttgctatcttctgcatttcctctaagccaaggatcagccaactagtatttatgggcccaccacctatttttgtaaataaagttttattggcacacagccactcccatttgtttaccttatggccatggctgctttccagctacaatggcagagttgagcagtaacagggactgtatagcccacaaaacctagataaaattcttattttctggccttttacagaaaaaactttgttaacccttgacaaaatgatatcattaaatatctgaagactgtccattaaaatacttgttatttgtggctccaaagacttgaactgggaccaacacgtacagagatagagtgtttagttcaatacaacatggatacatggataactttttagtaggaaaaacataggagtacttccttgaaggaaggtgaaaattggcttaaaagatgacattataactaattgcccaaactggaaactattagctcattacttcaggaattcaggaaaaccagtaccgtccagcgcaagcagaggtatttggcctctctgcctttaaatgagacagtcttcttgaaaaaggttatctctgcattttcaatattgaaaaggaaggaaggtggtgcaggtttgattaaagtcaaatcataagatttattttcatctctcacaggtttctgaggacaccttaaaaccttgactgtaagaggtgatgtgacaccttgagataccttgcctctcctgttcagcagtggggaggttcttgtctcaacagttgttgccccatactctgggaattcacctactggatggtggtggtggtagagaagataacttggacagtccactagactacatatatctccttcaacccaggggaaaacatgccttttttcaaaagggcaaaatggtaaactcagtcaggtgaatttgtgtgactaattggatatttccaaatgtttttaggttagtgatatatacatcatatgacttgtttctcaagaaagtcaatgtggaacttttcataaaacaatttttgcctttttttttcaggagaaaatcccactctgtggaagttagtaaatgtcccttctgtagttaaatttagtaagcacagatgccagctaaggcaggtgttggcaaaaatcttatggcacgcaactctgcaaactggtctccttctgccaacagagtctctgcaaattgtacttaaacaagcacgatgtgttgctgatttctctttcatattctctaaattgccagttgttttgttaaattctgtgttcttacagacatcagcatcaactttaataattgtccaggttttgaaggagatacagttgccacaagttcttctacagagtccagactctggatggacttggtccctcaagttgggactccattgctagtactctcccaatgactagcccttaagatatgtttattaatgttaggtggaacttcttgcttttgctcatagttaggaaagttgttcttaaagtgtattcttcagaccagcagcatcaacatcaccttggacttcttaaaattgcaaattcataggctgcatctcaacttactaaatcagaaactcaagcctttcagttgatttcaagtttgagaaccattgttttaggaaaaatacttaagaactgccaaccgtgtcttcctcatgaaatcacctcttttggttattcaataaacagttattgcctgcatgtgccccattactaagccatgtgctgaaaaagagtagcctatgaatgtcatgaatataaggatcagatctgtgttaccacagtgtgcccccatttgtgggcactgcatatggcttattattggtgtcaaatgaatatttacttatttaatttattggaatattaatacaactaagcccctgtcttctaaagactttgatatatggaatttcaagtgccgtaaccttcattactattgttgtatctctcttactccaaagaatataaaacgttggcaatgaattataatgaattaagacatttttactttatgcataaaattatgttaggtgtttttatttagatttgaaagcaagagttgtctttacaggcaaatcatgtatttcatatagcagaaaagtatggctgaggttgtatattttggttgaactagactaaattatatgtgttccttacttctactttgccttggttgtgtagacctgggtaggtctttacatcttcccaccttttttaatagttcgaagatgaaaagggggttctggagcaattccatcaatgttcgcactcttttagcctacttctgtaaatcactagagcagctgtgcaccaattaattgcaaaagcgtacaggtggtcagcagaatgacttgataaatgcactcttattttaaggggcctttcatttcttacaaaacaaaaaaggaaacagcttttaaatttaatgcagaaagtaaaggccaaaatagttaaaataaaaaaattagtcaaataacaacatatcctgtgctagttgtaaccaaattaaatggaacagttcacaggtgttccaaaacgatgttcataatattgttgaagaaaattgcttctcttgtttttatgactttaatactaggccaatctttatatacagtgaaaaatttttaaacagcagtgaaatgatgccattctatctctgatccttctctttatgtactgtactactgccatatatacacattaatctattactgatgactctgttattcacgttcctgtagccataaatatggatcactgtgtatcaatccagaaatcactcactctgtgtgactagataaacaacatatacagatcattttagtaaagaatgatcttaagtgagtgaacttgtactagaagctataattatacttaataaatgacttctatgcctggaaagaagtatatgtttgacttaatggctattatatatcacagcataaacactgcattcctacatcttttcctcccttcaacaaatccttacccatcacattttttcccatattactggtattgggctaagatttgtgaaggatacagaaaaaaatgagaagaatttctatccctaaagcaggtaagagaacaacagaagagatgctctctgtgtgtgtgtgtgtgtgtgtgtgtgtgtgtgtgtgtctttctgtctgtctgtctagctagctagctataaagatgatagaaaacagcattgctatttaagaggtaccctgaagtttatatgtaaaatgttttatgtcagtagttactcactgaacacctacaagtgaagagcctgcagtggaagttaggaatatagctatgaaaaagacagacgcattatttggtgtaatatgttttgccatctaaatggaaggcagacactaaacacatgaataaacaagagaattataaattgtgataagtaacatgaagcaagcaagacagtagtagagaataactctacttggtgtgggcatgagaatatgcccacacaaagacttgcaagtaaatggtcatggaagcattattggtaatagctaaaagtggaagccacccaaatgcccatcaactggtgttatgggttgaattttgtccctcaaatagatatggtgaagtcctaatacccagtgcccctgaatgtaaccttatttagaaatagagtcattgtagatgtaatcagtaaagataaggtcatggtagggtaagatgggccatagatccaatatgactggtgtccttctaagaacacaatgggaagacacacatacacagaaagaatgtcacgtgacaaccgaggcagagatggactgacatgactataagccaatgaatgccaaggattgacagctaccaccagaaggtaggaaggattctgcccagagtctcaaagggtgcatggccctgtcaacacctttatttatgacttctatcctctagaactgtaagagaataaatttcttttgcttagggccactgagtttgtaatgctttgttaaagcatctctaggaaactaatacaaccagcgaatggagaaggaaaatgtggcatatcctacagtggaatattattctgcaataaaaaggaacaaactactggtacctgttacaacatcgatcaatctcgaaaacgctatgttcaatgaaaggagccaggcacaaaagaccacatattgcacaatttaatttataggaaatattcagaaaaaaagcaaatgtacagagacagaaagcagattagaggtttcccagggctgagactgggaatggggattcattgtgaatgggcatgagggatcttactggggtaatggaaatgttctaaaactagattgtggtgatagttgcatgactcagcaaatctgctaaaaaccattggattgcacacttaaaattggtgcactttttagtatgtaaattataccttaaaaacttgttttttaaaaaaaattatcaatggaaacagacaaaggtagaagtttttatcatttgggtcatttaaagaccattgtgggctagagagtagggcctacagaggagagggaaaggcaggcagtaagtaggtaaaggattctgggagagaaaatgttcagtttgggcctaaatagataggattttaggacgcggagataacagttcagggatctgggacattgcatctctgcgttgccagtgatattttagttctttcaaacaaggttgtgtgacatatatttgctccttggtggaattttcatgatcagattaaataaacacaattttatatgtgatatttatagacagagagaggctgggaaaaaacctgaccacttctaagacctccttggcttttgtattctaaccttattgtctcatctccctctaacacatgatacactgcaaggcaggctgtcttgatttcctgggaagacgaaagacctccttctctcaaggcaattctttttaattaacactgctctcagagtatacagccatatacacagcactaaaaggtgttaacttgctcactgcgctcaaagtcatactactgatatttatgggatgatgattcaacggtacgggctgtttgttagcaagttcaacagctgtgtgtgaatgttgttgtgagtatgcactgagtctttaccaggccagctttgtgcagatgctgaaagaaaggccagcccagactcaggggcaagagaactcagacagcagaggctagcccagaaaggaggaataattttgtaaccgaacatgtcaagcatgagtgtaatgtatttgaacctacttttgtagtgttattcatttcgtggtgagaggccttcgtaagagattaagatgaggagtcaggggcctgagtttcaacaccgactggttttctgtgggactaaagataaaccgtttaactcttgagattacagccttgcttgtaaaagaaagggatagattagaactgtgatttttaacctatggagggataagcgtcccttcaagaataggttgctagccgtggatcctctctttagaaaaatgtgcatccaggaggaaattaatacccagattaaggttgctgaaccaaatgatatcaaaggtcccttccaaatccaacactcctcatcattccaggaaaggaagaaaaatgaaaacaagaagaagaactattatgttcgagtttgcactattgacaacatactttatagcaaagttagctagactgtaagtcatcagacacccagggttgattctgtttctcacagtttgaggagatcctcttgatgcttctcaaactctgaaatggctgatgaaaagggtcacctcggtggggtgcggtggctcatgcctgtaatcccagcactttgggaggccgaggcagacagatcacctgaggtcaggaattcaagacgagcctggccaacatagtgaaacctcatcgctactaaaaatacaaaaagtagccatgcatggtggcacgtgcctgtagtcccagctacttgggaggctgaggcacaagaattgcttgaacccgggaggcggaggttgcagtgagccaaaattgtaccacagcactccagcctgggcgacagagcaagactcagtctcaagaaaaaaaaaaaaaaaacaggcaagggcccacctctgcgaagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccattttttgtctttaacctttccttctaaggttcagtctctttttcctctgactatgggaagcctaaaggagagatgaaatggagagccctatctttttatagtaagccaggtaattccaaactctttatgggcacagttgaatcaaagatcataaaaactgatcagagatggaataagaataaatgtattagaacaattagagcagtggcaaattgagtcaagcatgtattgataagaaataattgataaggccaggagcagtgactcatgcctgtaatgccagcaatttaggaggccaaggcaggtggatcacttgaggccaggagttggagaccagcctggccaacatggtgaaaccccgtctccactaaaaatacaaaaaaattagctgggcatggtggtgcacaactgtagtcctagcaactcggggaggctgaagcaggagaatcgcttgaacccggaaggcagagattgcagtgagccaagatcctgccaccacactctagcctgggtgacagagcgagacttcgtctcgaaaaaaaaaaaaagaaaaaggaagaaagaaataactgataagtatttaattgcaaagcatggacttagtttgttagactgtgttaccttgggcataattgtagagtcattttccgggatataggaaaagtgggagaatatgaccctccaaataagtgtgccattggcaaggtaggtgtaacttaaatgttttctgtagctgtatcttgttattcttttttcacaggtccaaaatgtaataaaaatacaggcatttgatgttaccttgaatatactaatttatgattcatttatattggccttggaaatgaaagtaaaagttgtggccacagaatgattactcagaagaattattttattatatagacataattaagcatgcaggtatttttgagtacttttattaataaatcttacaaatttttctgcagtatacttccaaagagataatttaattttcctgatgactagcacttcatccccttctcctttttttccttaagactaccttaaaacaatacttttgaggggcaaagttgtatgcatggagaatttaatccaggcaaatggtgtggttctgcgacacaaatttttctgtagcagtaactgggagaagagccacaattcatgactgctggagataggacctgctttaaatgaaggaattaattgtgcacataatgatgtgtataagcattctgcattaacagaaaaatgagttttacattttatacattttaaaagaatctccaagacttagcccctttatttattcacaggagtgatgggtgaatatgagcccaaaatagaagtgcagttcccagaaacagttccgactgcaaaaggagcaacggtgaagctggaatgctttgctttaggaaagtaagttctggtttgcgttccttctcatcctcccttcagcttgagcaggtatagagtttttcttgcactgttcacagcgatggtttctgaggtgacggaaaagcaagtgaagcctttctctttgtaattctgtgtatgcatcttggattctgcccctcaccatggagagaggacatgtaatggtgcaagaaggattaggctgccacaactgacatgaccacaaaggaaaggagaatgggcaattctgaaaaagtattttgttctattatcatgacctgtaatgtgcatgctgtctaacccagaatgacaggaaaacaatggcctccacttgaggtacagttaagctgactatgtggaaaaatacggactttcattttggccccagtttatagaggatgcatcagacttttcttgaatttctttttaaactctcagtctcttctctctactttggatttccttctcctctggctagagataggtaagacgtgttgttctctaagagagtctgttttacaaagttgtccaaatattgtttacaactttattattcagtgtggacttccttgagaaaagcctacttctaaactagctaacttttccttacagaatatatcagacagcataaagaacatgaaatgcacatcatttgggatttttatttgccagtaaccagcaataaagatttggcataaacagtataaactattatctgaagtgagaattttgacatcttctttggattttaatgatccgtgtcaatctttatgcccagccccatctatctgacgaatccattactaactctctttttcctgcgcccaaatgttgactaaggcaacaacagtaactttttttttttttatttttcggtagaggcaggatctgcgtatgttgcccaggctagtcttggactcctggcctcaactaatcctcccacctttgctcgtctaagtgctgggattatagtccctagccactgagccaggcaacactaactccaccaatccttatatcagcgtgtaatctcttttcttatgatttttgtgttttacagcaatcatagaagaggttcctttttccattttattgtcggttctaatagaaaggttgttttggtttccatgtgttttcaagtcgtgacaaataagctacagtcgtatctttactttggtacagtacaatgcagtggtaattttttatgtcctgaaaacttatcatattaaataaattaagacataattataggattgaacactctacagacattaaaagtcaagttgcaaaacaacatttaagacatagaaaatgcccatgctaagagaacaaaagcagattgctaacaggataatatgattacactttttatttttattttaaagtatttgtgtataagcatttatatatatgaaattaaagatgagagcaggtaactgggtagtctagatatacatttgatgaattttttaagatgacaccttgaaaaatcatctgtgaaaaagagcagaattcacgttgttcacacttcaaagggggttatgaattaaactctattcacactgtttgaatagtgctggaataaaaacaaaaatcccaaattggcttcttcagtctacacagaaatgtttgggtatgcacatccagctgctgaaacacatcatcactgcccacttaagagcaggaagactacatctcagtatggttatttttaaaggcatatattaagtgcatatctcatcagtataaagacaccgattatgtacttttcatagaccttttctgcattttgagttagtgtctgtctaacgaacttaaattcttctaaaacaaatatagtagagttgatggctttaatgttttaaataccatctcaggtttcccagagaagattagcaagtctttagtctaattacttctctgtgtgtgtatttgtgaaaaataaataagtaaataattgtatcccctgccaggcagccacaatcttaaaagctgtggttagctcactaaaccattgatttgcagattcaatgatgccctctctgcaatttaagatttgttccaacagttatggcagtaggatgatagatgccttgagagtacataaagacctcacagatggcatctttctttctctcactattttaagcgaagtttccccaacccatcttgcaaatggactgctgtaagttggtaaggttctcaatatataaatgacaaggagaaaaaccatgttgtccaaaagaatgtaccttgagtgaacccttcctgtatgtcagcaataggttgtgtctcccaaattttatgagctcattatttctactatcatttattcattatttggatatttctcaaagtagggcacttgcattgttggtacatagatttatggaaatatattgtttctgttatctattgctacataaccaacttagagggaacaccagaattttattatatcttacaatttgtgggttaagaattcaggcagggcttggctggctgattcttttgcttttagtggcatccttcaggtctttcagtagtatttagctgacagatgaactggtctagaaagctcacaagagtctcacacacatttctggtattttgttggggacgttggaaggctggtgtcactgagactgttatctggaagccttacgtacggcttctccttcctggcggtctcaaggtattcactcttctcgtaggacagctcagggctgccatgagacagaaagcagaagctgccagtttcttaacacctgagctttgatcctgcaacatcacttctgtcttatttattagtcaaagtggttaaaaagcgctaccagattcaaggggaggggccatagacctcatctcaatgggaggaatgtgaaagaatttgcagctatctttaatttgccacaaatgcacatgaacatttttattttcatattttttatttagaaaaaaacatgtatgggtgaaaccttgtctctactaaaaatacaaaaattagctaggcatggtggcgggcgcctgtagtcctagctacttgggaggctgaggcaggagaatcacttgaacccaggaggcagaggttgcagtgagccaagattgcgccactgcaatccagcctggtgacagagtgatactccgtctcaaaataaaaaaaaatatattaaaaaaaaaagaaaagcaaaaaacatatgaggaaacatatataacatataaaaatctgtttttatttcaatgatgatattgtataggagatagatcacttttttttttttttttgagacaaagtctcgctctgtcgcccaggctggagtgcagtagtgcgatcttggctcactgcaacctccgcttcccaggttcaagtgattctcctgcctcagcctcttgagtagctcagattacaggcacctgccaccatgcccgggtaatttttttgtatttttagtagagacggggtttcaccatgttggccaggctggtttcaaactcctgacctcaagtgatctgtccgcctcggcctcccaaagtgccaggattacagatgtgagccattgcaccctgccagatcaccttattgaaagttaagaaaagttatttgattttaagaacactaaataagtaatgctagagatgtggatatgattaaagttataatggagatagaggaatgaatgaagtttgcaaaacacccaaccttatatgtgtagaaccaagaaggaagcgtttaggttcagataaaaggtccagttttctctagtttgattcactcctttttattcttgctatcagtccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatggtaagtgtatgatttcagtttatcatttatagtgctacagaacttcctgatattgaaatcataagctgagaggcattcaggcattttgggagagatggtgcagaataggactgtgtgaaactcatggtttgctccataatcagccctggttgattctgggtgtggagagtgagggtggggggcaagggtgttgacggagcagagaggaagacattaggctgatgtgtttggaggatgggtattagtgtgaacacacttgcaaagaagtctgtttttcctctttgcatcaagctgtaaacctgacacaggaaacgttttattattcctactcctgatttatctttttttttttaagctctgtgcttttcttcattagaattttgatttgaggcttgtgctaatcttttgtaattgctcctatttgttagcaatttaatgtggtaccatgaacatttcaaaatgcacactgtccaaatttagttcttatcagagtggaacgtgacaaatctctctcaccccaaagactttttatgtgcagctgctcctattccaatcaaatcatcagcattgatccaaacaatataaatgtaaaaccactagcacatggtcattattgagaccatcttggaaaccctgttaggatactgatttgaaatctcgaaaaggatttcattggataggcattttgaaagcaaactgagttctgccaaattggagcatgccagaatcccatctgtctgggatacagaaaacaaatactatagattgataattatttaagaatggtttaaacaaacaacaatgcatattaaaatgatgagagtagttctgtagggcaagttgtagcaaaagctttaaatgttcttatttcttgcagtaattgatcccacaaaagtctatttatttcactaattcttcttccaaagcattttggttttaagatatgaccgaagttctaagccctccagtagacagaaggggacccctcttggctaagggggggcccagagtaacattgaaaaatgagttcttggccatgatgggagggtaatgtcagacacatctagttatacctgctcccttgctaaccgcaatgagcctttcttccctaagggctaaacacaatctagccctttgaaaagactccatcactgacatcaaccatgcacctgatgctgccccttattttttgcctgataagagaccaccaacacagaatggttctgtcattctagggaggatgtgccgtgaggggtttcatgtcctctggtctaccttttgacatcacagggccaaaacctccaccctcagatgctaatactgccatttttcatacccggaacccatgaagggttgcacatgcagatggttctcctttcataaatatccatgactcctcctgtagcttattaaatatgtatattcatatttatatacatatgaatatgtatataaattcatggcttctgtgtatgaaatatacatatattcatatttatatacatatttatgtacatatgaaaatatgtatatttcatacacagaacccatgaaactcagttgcacatgcacatgtttcttctttcataaatatccatgattcctcctgtagcttattaaatatgtatattcggccattccactcagcacaaattcctgtttgttccctttgctcctccttggaagtgcctgtttacagcttctggccaagggaggctacgcttcctagcctgtcagaatggccaccaggcagactaataaagctctcccttccaaaaagaaagaaagaaatggaaggaagggagggagggagggaaagggaaaaaggaaggaaggaaggaataaaagaaaaagctatggccaaagaattctgatcgataatcacgtaacattttttaaatcttgattggaaactgggcagagatttccactatgagccagccttcaatgacctcccctaagtgactctcagcatttcattttggactcacgttcccctgatgcagcttctgaggggagagaacacacagagttgtagaaagtattaatacttcacttgatgagctgggcagtagctgtttgaatacatctgcacttctcttttatcattcgtctgtcttcaagaatattaaaggactgactctcctcatgccagatgacagacttgatatttaatctttgctttcctcttaaactgtcatagttggtatcttagttgatgggttgtaaagcaaaagacaccacagttaactgactgcaaaatcatgagactgtaaattacagatttattcagtgagatgctatggctgtgtatttttaactgtgtagggctcgtttttctcaccaatgtaataattattttttctatatcagataggaacaatctgtaaatattcagataattggccaacattttctcttttttcttggttgaatagtctcttcagttcagtggtggctgttcctaaatgttatttgagtagcttaactaattgaataaagtcattttaactttcatgattttctgttaactgaaattcctgctctcagtatgttaaactggtatgaaattttctgcaaccaggggtcggcatactgctttcctgtgggttagaggtttcctgcactggaaatacagtactccaggattactgttatggaaaatcaactttgtcactggctcccagccctgtgcagggaaatgtttttttcagggatcctgccctggagatgaaaatcaggttctaacaatgtttcctttttaaatggagttatctgcagccatgcatgggaaaaagagcagaataaaataaaatttgcctgctttctgaagataactcagccttagctcacttgtcagccacgcttggtgttaaaaacttgtcagatcagttgacttccacagcacttggctattgcatttatgtttattcttttgtttttcctcatctagcacatcagtgacaaaaattatctaattgttttcattgtcacagccacaggagagcttaattatacataagcacttggctgtcatcttttttcctctcacttttttctggtctgggtcttcccagtgctgtgttcctaatatccagctgcataggtctccaatttaaatgaattatgataattaaaatcaccatgtagatgataaaaggtgagaaagtaccccagtcacttatccatgaacattctgtctttgttgacaagaatttcttacaacctaggaattataaaccatgggtttgagcttagaaacctgcttctttgggttccaggttgtttattgcattcatcagctctccacttcagcaaccagaagtgtgctaactcctattcagggttggcaaaatggcaatttttttccttcttgcattaaaaccattttgcattaaaaccattttgccttctttcaaaagcctactaggcatgatgattgttcccagtgtctgaataatggaagccctattgccctttggtttgtccctactgtagccatgtctttaagttaccctgtgctactcatgtttggtatgtatgaagaactgaagcaagttcagagatagaacatttttaccctaccccatcttcccaatttgtttttgctataacctgtacggtctagttgaatctacttttctcagtctgtttttggcattaaaaacttcctaaaaatagatttattttcagtggtaaaatgctatggatctctgttactaaagataaacattttccaaaatgactttaatacattatttacttgtttaacaaatttttttttattgcctaccatgtgggagacattatcaggcactatggctgcaagacaaaatccctgccctcaaggacctaatattttactggaagttaaccaaaatgcactattaagcaaataaattaactaggaaattttattttttggtaagagtgataaagaaaataatgaggttgattggccaggtgcagtggcttatgcctgtaatcccagcactttgggaggccgaagtgggtgagtcacttgaggccaggaattcgaaaccagctccgtctctactaaaatataaaaattagctgggtgtggtggtggtgcatgccggtagtcccaactacacgggaggctgaggcaggagaatcacttgaacccaggaggcggaggttccagtgagccgaggttgtgccactgcactccagcctgggcaacagagcaagactccatctcaaataaataaataaataaataatttgatatgatagaaagtagctgagagcaagagaaagatttcataagatgaagtagtcaggaaagacttgtctgggaattgccctctgacccaaaacctaaaggatgaaaatgagctaggctttcaaggggaagtgcattgctggcagaaggtgaggaagtgcaaagactctgaggcagaaaactacttgactttcttgatatgcagcagggaagtcagtgttaactaaatcatagtgagcaaggggcaaaggtttgaaacttgggaaggtgacagactgcagtactttgtaagccaggcacagagtttgggttttattctctgagtaaaatgggaagccattacagcatttcaaggcaggagggtgactcgatttgattaatgttttgaaaagaccgctcaggttgttttgtggtgaatggatgattggaaaccaagagcaaaagccggaccattgccaatatccaggtgagagacattgttggttaggacgtaagagaggaagagaaatggagagacttgagatatattttggagttagagccaataggatatgctcatttcattcctacatctgtctagtttatagatatggaaattgagtcccaaagagattaaagtaattgatttaagtttatacagtaaaaaacagagctagatttcgaatgctttgctagaggttctgaaacttcagtgtgcatcacaatcacttggaagtcttattacaacacagaattctgggtctcgttctatgttcccagtgggaacataccagatggaggctttgatttggtaagtccagggtagaaccaagcatttgcatttctagtaagttcccaagtaatgctgatgctgcttgtctgggaaccacatagtgagaatgctctatgtttaggttgtccacccatggtattgtgaagctgaagattaaatgacatgcaagagaaggtgttcctgctactctggaaagctaacagcttactgtcacatcaggcattttagccagtctacacaaagtagaatgagagcgctaaggcaattatctttgaagaaaggaaagggaaatataaaatgtatttaattcacttggtaattattcatctttgcacttcattctgtctctgtagtcacttcctttttgcccaaaaagactgatagaattatagtcatcatttagtagaatgaagtgtgaactacaagagcctgatatttaatatctttgtacagtttcttctctttgtaacaggtgttatgagagttaaaccatcttcataattaggaaatggggaatctaatatttgagcagtaaacaaggctgtatttcacagaatccagtaatacttaagctggaagcaactgctggggccaaccctttgatttttataattaaggaaaataagatccagagatacaaaataacttattcaaggtaatgcagtgaatgggaatcacagctagaactgcttttttctgctattctacctgtgttacttttcctgccaatacaacattttaatacaataggtaaggtgaaaaaaatccatcaatcatccggatactctttcttgcgttttccattaccagtgtcacaaatgaaaacatctggatgaacaactgactttttcactttctattttctaagttggtcacctggttattgagtccaaaaaaaccctttttttcttcttcaaattacatgtaagactaaatgtctagagcctttgtgctacagtcctttgcctctaaaggcaaaactgtaggcttgatgacactgcaaatggtgtttgagtatctctaaggtcatcaataaatgaatacttaagcatcttacagcagagcatactaattccccatggatgtgctatgtatatgtgatcacaagataatattcagccctgcaaagaagcttaaaggacagagtaaccaaagactgaacacagtacataaggtaatttcacagtagggcaatagtttgcttaattgtcctagacagaactgatattgataccctcaattcccctgtcacttaagataaagtcaacaatttttgtttctttctttcatctgatagttccaataaagtatgttgctacagtttttaaggggtacgcattaagcaaacgttgcgaataatagagagaattaatacaggagtggaggcataaagtcctcacctaataagaaacgttaagccatgaaaaaaagagtcatatcaaggacaatatattgaaatgcaattcaagtcatctcactctatagtcccagagaaggcaaaatgtcacagttacatttttttattcaccaatgaatattgtttaaatttacttataggaggttttgcttaagttgattcatttatctagaagttcctctgcttgtctaagcaggagggctcaaactgttggtttaaggactcctttttaccctgaaaaattattggatacctcaaagagcctttgtttatgtgagttatatctacccatatatgccatataattaatttaaatggagaatttaacttagaacttaatttactttaaaataacaaaaatacaaccagtatatgttagaaataattaacataagaaaactgactatatttttccaaataaaaatatttaatgaaaagagtagcttggtttatatttttgcaaatctctgtaatgtctgtcttactagaataaaagtgcattctcctatatacttctgtattcagtctgtcatgatattttgttttgattgaagtatatgaagaaaatatggtctgacacatatataattggaaagagaggacataatggactctcttaaggaaacctggggacctacaatggttcttagattgcactttaagaaggatacattcaaaagaatgctaccattgtcatttgtgttagggttggacattttttgagaggctctggacagagaatggatgttggagccaagcaggcctgtgtaccattgctaactgagctactttctgaatctggatgttaatgtctctgggccttacctataaaatgagtacaagtctacttaacctgaatattattatgaggtttagaaatgatgtgcataaagtgaagctgattagatattccatatattagtagtttccattattggttgcatttgggactgaactcaaggtgtataagggaaagagaaggggatggattcagctgagtaagagcagattgagggaaacactaggtagaggctttgaagattaaaaaaataaaagaaagaaatatagagaaatgaatctgtgtaaggttagagtcatagcttgattgatctgggtataactgagtaaatcgggcccaacagcctttttgaaaatccacatattgctgatttacaatgtttttattctataactcatttataaagttctgaactgacttattggagtggaggacaaagacccttattcaccaagagctgtgaattcaatgggcatagttggacagaaagtaagagatgtaggtaaaatcagatggcagaagacttcattttcatttatgtatttgttaatttattttcgagacagggtcttgctctgtcccccatgctggagtacagtggtacgatctcagctcaccgtgattctcgcgcctcagcctcctgagtagctgggactacagacaggcaccaccatgcccggctaatttttgtatttttaggaaagatgaggtttcaccatgttggccaggctggtttcaaactcctgacctcagatgatccacctgcctcggcctcccaaagtgctgggattacaggcatgagccaccacacctggtcagatggcagaagactttcaatattaacctaaagatatgaaataatgataatgttctcctaattttcataacatttacaggaggcagagcacattcagaaatcttacttgttatctcgcatacagattacttcctacagttatatttgctttatgtattcatgaatacctattaatagaaatatgccagctttgagttgccttctagtgtatcttcatatagttggtttttatatctgaacttgagtttatccttgctatccgtgctatctgtaaaaggattggcctatgggagatgccatctcccataccattgccagaagcaagtcagttgtaacttatgtggagatgaagaagccataaataagagtgtgtgaatgaagtacaaattaacagaaaaactaggagaactatgaatcctgttggtttaagagacaatctaaaggctaaaggtttcacttattaaaatcaaaaggaggggctgggcgcagtggctcacgcctgtcatcccagcactttgggaggccgaggcgggcggatcacaaggtcaggagatcgagaccatcctggctaacagggtgaaaccccgtctctactaaaaatacaaaaattagccgagcgtggtggcgggcgcctgtggtcccagctactcgggaggctgaggcaggagaatggcgtgaacccagaaggcagagtttgcagcgagccaagatggcgccaccgcactctggtctgggcgacagagccagactctgtctcaaaaaaaataaataaataaaaatcaaatcaaatcaaatgaaaaggagtgttagacatcattaggtccaaacgaatctgaattcaaggagaaaacaggcttccaatccccagactgcatttccaaagccgttcttataatacaagatatcagccagtatcagcaaagtatgtgtatgtttctcaaggtactttttttagcatgaaatttcacaagaaattctcaatatttaatacaaagcaaggctgcagcaaggaagcagccttgcgttgtgttaaatattgagaatttgaatgaatgtagaagggagtgccttccaagaaccctcagagcttcatggaattgagtttgaagacccctgtaaggagactgattggtgtgtggggagtggatgagagtctgaagccagagaagcacagattatcagtgctgaacaaacaccaaagatggaccttgccctgaaatccaacatgcatatttcttgtagagctggtccttcttttcagtgacttctgccaactggaagtcaggggtttatgagaagactgtaataataaactggaagactctcttaagtagcattggaaaatgactatttctcgtgccaatactaggaacactgaatttgaggtaatatgagaatttcttgatgattctgtcaattgcataagaatcccaggcaggagatagagatttgggaagcatctatgtatataggtggtaaactaaagccaagtaattatctccagactcataaagtctactatcattaaaattcttcagcaatgtcagtgaaactcccgcattccctggagatgattcatcttctccaaaattgtgtccgcaaccagaaataactgtgaatgtctacaggtcatctttgtaatagtaatttagagggttttttttttttttttttgctatcacatcctttcttttatatttttaaatttctaaggcctaaggcatatgttggcatttctttcagttagaaatttctgtttttagaaaatcgaagcgccaaatactcctgagaattgtttgacccactgagtttaaattatatctgcctgcaatataaattattattggataagatgcttgtacaattccagtggctggaatacacaaacgctgatttaggtcatttctggcagttattgaacaaaagattgaaatgaagagattgtttatctatccaagagacaaagtgtgtcacagagtcaaatcccagcacaagcatttaacattatatttgaatttgtagtttgagaacaatacttaaggagtcctagaagaattcttttgtttcaaatcttgaaagaatatggaagttcaaaacagatggttctcttttaatatgtgaatgtgtttaattctgcttaatatgtgggctctgtatatattacaaaaaaaaaaagacatttagaaatggcttctgaaataatagtattgaactaacctgttcaggccttcctctgagttgatacaggttgagtatctcttacctgaaatgcttgggaccagaagtgtttcagattttaggttttttaggattttggaatatttcgacccaagcctaaacatgaagtttatttatgttttagatataccttatacacacagcctgaaggtaatttatgcaacattttaatattttgcataatttaatgcatgaaacaaagttttcactgtatttgactatgaccagtcttatgagatcaagtgtgaaattttccacttgtggcatcatggtggccctcaaaaacttgtgaattttagagcatttcagattttagatcttcagattagggatgttcaacctgtgtttagacatggagttgtaaaatatagttgaaccttgatattaggcgataaataccctgtacccaatgcattatcacaaaaggggaggggctaatgatgtgtcttataatatgcttaactgggatttttgttatctaaggactttgaactaggtaaccccccccaaatatggagatacatgagtcattttcatcaagcacatgacttcatttattctagtttgaaaaactcactcgtttagatatgattcatccaatctaagtgagcaggagtgaaaacgtttactacatgggcttttgccctgtagatttgcaaatggcgtgttaagatagactgtctctctttgtcacatatataatatgatacttcatttctgatcttcatgggcccacgttcagatattcactttgagaggaatatgtttatatcagttcaaatttgtcttctatgaattaattttactttaaaaataaagaaagtgccaggtgatctcccacagacactgaattttttgttgatttcaccttggcccgcacaaataactaccactgagtattctcatctggttccttgacctccataaccctgtgggaagagacagaatgagccctcagaagtgcttaactagttagagctttgcaaggccttttcaaaattctctccagtccctcccttctctgcctcacctgcttcttgagattgcaaggttttgcttccagctttctgcatttttgcaaaaaagcaataagaaagcccaagtgttacaggaaatctatgacattgaaatctctctctctgcatgtgattttgatgtttcctttttgaacttcaacttgacattgcttcataagttacatttgcccttccatttttttcctcactctctttcaaaagtttggcttcattgttaatattcctcacatacttctgtggcttttcttgtttgctttgttttcatggactctgtaggggtcaatattcagcaggttgaatgtgaaatcaggcatgcaactgcattagccatcaaattctccaagcagagaacctttttagcttcctttgcattagcagcaggaagataaagaacaaggaagacttgcagctcttttaagggtgtaggttataacccttcattcaagttgatgtttgttgatgttctaaatttttttgaagttgacccttttggcctcccctcatatgcagcaatgcatcatcccatcagtagaggatttgtaaaactgtgttttgctcgttgaaaaacataaaattgcttatagatgagaaaagaaaaaagcagcatttattcaagggcctagagacctctgctggttaagtgatttgttgagtgtctttctagttttgtttattattgaaaaggtgaaatacagtttggcctcaacagtagcaatttccttttgaattaaaattatggatgatttgaaacattgttgagtgaagatactgaggtcaagtcagctggaagagatgttaagaataatgagtagcatctcctaattaaatactgatatcaactttgattattaggtttaccttggtaggcattaccctgtagaaatgccctgtgaacacataaagttccagaatgacagctatggttatcttctgcatgactttgggctgaaggtcttctacctgaatatgtttatcattattcttaatggcatgaattgtgcttgaggcaagatttgatatttatgaagactttttatggaacatggaattaacattgtctttatatctattgaaaataaggaaagaaaatgtgacttcaatgaagtacagaaaatgtattatcatttgggcagcgggggtagtggatagcagtgggcaatgtgggaattaagtgctactttgaattcttgtgttagactgtgggcaggacttgatttcctgaggaggtttgataaaaatcagaactcatttaaagatttggggttctagggtcatattcctgtagataacattctatcaatacgaaatcaataataaacaatgatgatagtcttaaaggagaaaggaatcataaaattgatctatacaacatgtgggagtgaagtatattagtgagggacaagctaagctattctcacaaaggaggccccaaaataaagtagcttagatgaaaagtttatttctctctcacattattttcctcaaaaatggcaggtggatgtggagctgctttgctccacacagtcattcatggtccaaggctgacaggtcagcattttcatcctatgtagcttccatgtctgcacccaaggctatttcaattgctggtcttttccaatcagtgtgaagggaaaaagaagaggttacggaaaatatctttaagtgaataacccagaagttgctctcaccactttcacacacatacagttggcatgaacttggttacatagttacctctagctgcaaagcaatctggcaaatgtagtgcctacctggaaatataccagcctggttaaaagtgggagggggggtgatgggaagatattctctactgaaaggaaaaaaggaataatagatacttacaggagagggacagttaattttgccatatggatattggtagttttatccattttgcatttagcgattaaaagactacaatatgaaccacaaaaatggtattcagagtagggtataggcacctccctgaatgtctccccagtcttgttatttgcataacatctggaaaaggaattttattataagtgtacttttgccctttgattgaatatgataaaaatagattgagtacacactgaatatacacctttctttgctttttggatgcctatagctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggtaagcaagttaatggtaattgtgccttagtcttgactataacgtttaatatagcctcattgccgtggaaacgggagaatggtgaattgtttctaaaataatatgcaatgaaacagcattatggtggaaaaagtgagagtgaatgcaattgataaatagaaagtgcacttaaatccagttctccagctttcaattaagctcttgcactagatctgtggtcttcaaagattaacatatgtgactttataatgggaaagttatgcaaaaggtctggaacatgaaattgtgctaagatacaaaggaacatacattccagcatccactacaagagaaggggcattgacacaatacaggatatccatctaaatagagaaacactctgacaaagaaatctgaatgaagcaggggtagagcggagaccctgagaatgaggaacaattgtgtccaatttaattttccttatgtattttcctgccgaacctcaaatattaattgaaatttgacattttcctcaggctccaaattgagaggcagtctttcatgctcagatttcttcctccagtaggccacccagaaaagagtgcctgctcggagcaatggccctcacatgaatttacatgacaggaagagaaaggggactgttttgcctaactcaccccctgcctcatgcaccttctccatttgctggaagggctccagcttgtccatgattctgtcaattataaaagccaaactcagacaaattgcaggggtataggtacctaggtactggtattttccttcttttgtgtaattgttaccaaaatgccagggagttggtctaggtcctgttgcttgctgtgcagagagccaatcactgagagagtgagtattgccaggaaataaggctttgttcaggtgctttagtcaaagagaatgggagatcagtctcaaatccatctctccaaccaactaaaattgggagtttatgtagctggggaagggatgcagctgtgtgcaggaaggaattaggtgggggtacagaggcaattatgacagatgaagggtctggtgtctcactgtctggatgccatgatctagtgaatttgagtcccttgcttgaggatcagcctcctgaggagtgaactcagtgagaccaatgtaagtttcaagttttaaaactaggcaggtcaatttctgggtttattcaaaaacaggtaattatcatttctgtgggacacttgggcttgtttcttaatgtgagggaacatgaatatctagatttgatcaaagtctaataaagtgtccactcagctaactcacaaccctgcggcaaacagaaaactagtacctctttatatatatgtagaatggcaggtctcctggagaggaggagatcctttttgatacttatgaaaattgacacataagttgtatatcctcagagtgacaaataaggaggatctcctgtgccacgtactaactttgcccccttcagattggccgccaccagatggtcctcagcttaaatcacaccactgacagcaataaactaagggaatattaaactattaatacctacattttttagtaaacctcaaccaatattaaatatttgcctctgtttcatccaagattgtaatcctattaaccttcaaagtatcacctgctcaaaatgtgagtgttttaagcactctaaacagtaaatttagttttatttccgaaaccccctaactctggtcagtacaaagccttaaagtgaaaaagcattttaagtttcaagttattctatttagagaggatattaatctgaatggctccactattaaatcaatgagaactcaagagaatcctacaatttaaattccatttaccaactgatgtactggttgttccatttagcatctgacctgctacaaatttagctgacagataaatagatcatgttatgtaaattgcttatatgatggctgttttcttcccattaagcttccttgatattacacatggtaaaattgccttaaagtctcagttgtagaaggtcattgtttttatgttcctcttttctttcacaggatagaattcaaattgagcaaggaacactcaacataacaatagtgaacctctcagatgctggcatgtatcagtgtttggcagagaataaacatggagttatcttttccaacgcagagcttagtgttataggtgagtctttatactggcaagaaaaaaaaattaaaactctttagatcactaaactaacttgttctttgccaagcataaatgttcaatccaagaaaaggagtaaagaaatctttaggccaaagatgctactcaagaaacaagtaataagcaagtctataaacaataacaagagaacgctttctaaatccgcctcttctgatgcttacaatggggaccatgcttcccttggcactcatttttattcctctattgactgcacttctaaattgagcaaagtttttgagatgctttttggagtctgctgctgatttggtgcaaacttgagcttggagggaataagagctgacttggtttggaaaggcttatttgaacagctgacagaataaaccctgctcttccacatctgaatttttccagactgtgcattaatgatctttcttccaactacatgtttgatcgtgtgccacttcctccctcctcttcagctgcattgacctttctgttctgcatactcaccatcctcccgtcctctgcaggccactggtacatactgagtgcatcgtctgcctgaaacgcttttccttcccctcttcatttctgtaactccttctcagttcgcatcttccatcttcattggtgcttcctcagaaagtcatgcttgggtcaactattcctattacagatttttatactatcttttacctctcctttatgaaagatgccacagttacagtttacacttttttttgtgatctttctatctttttcttccactgcattttaacctccccgtgacgtcaaggatcataattggttcaattcatcattttattcccaggacttaatacagtattgaagcacatagtatgcactcaataaacattgaatgaatgtaagaatgaatgagtgtgttaaatgaaggaagaaattgagagattattttattaaatggattaatagattaggtcagtaaagaatcgaaaacatagttgagtgaaaagataaatctatggacgttaaaaaaaaaagttaagaccaacagcttgcattatcctgtagaaaaattttgaatttgtctattattataaaagaagagatgataatgacaactgaaaacacaaaaacaaatgcaaatgatttgggaactgcctcctattttagaggctttcagtagtcattctccttggtgagagcataatggaagactatgaataagagaaaaacagcacacaaaggagctaattcacgtgctctgataaattgtccagtttcagagtcctgactttcccttatgaaaaacattcattggtgcctagcatgtaaatcttgcatatagaagtaaatgttctcaagtagaatgtacttccattctgtgcaatgtaaaaaaataaaaagaaagaaaaacttccacactgctcttctcactaagttcgttagcactgactcaaatcctatcaaagataacgattgtgagatttcatggggatggagcctttttcaaagaggcctagtaatggttttatgctcttggcatagatagcatcagcatggctaggcctactggaatcctaaacacacatacttctcaccctataaatattaggaacaataattttcaaccccttccaggacacatatgatgattcccttctgcccggatttgctaactattggtacttggaactgagtcttttggagtacagttcaccatggcaggattgcttaggagtttattccaaaacaagtgtgttctctactctactctatatcagctagttggaagaacagctaaaagtgagatgtggcctaatgaaatgaatcatagtgtctgaaaaccctctatatgagcgctagccaatttatcagtctagggacccttttataattttaagagattttgtagatccctttattaaaataagaaaatttgatagaaacaaatgactccaacaaagtgagaaaagctgcttaatgatttatatctagagtgcctacccatagctgaaaataacagaatatatgtgtatgcgtatgtgtacgcataatggcttaaaaccactctgcacagccctcccctctctccctctagtactaggattcaaggcctgttagctgggaatcactgttccaacttttacattaaggagtttatttaaaaatcatttccaattggaactgtctaattacaaatgaatttttgatctgagctcttaagtttcccgacgccagcaaactagaagtgttagtctgtttaagctgctataacaaaaatactgcaaacatggtggcttatagacaacaaatgtttatttctgatagttctggaagctgaaagtttgagaccagggtgccagcatggccgggttccggtgaagtcccccttctgggttgcagactgccaacctctcactgtgtttgcacatggcagaaggggtgagggtctcttgggcctcttttataagggcactaatcccattcataaggtgcttcacccttatgaagggcttcacctcataggggcttcacctcttaaaggtcctgcctcttagtaccatcaccttagcggttaggatttcaacataggaattttggagggacacaaacattcagactatagcagtagagcagtcaagataaaatgaaaatgcctgagaaattatttaaccatgtttcacataagaacaataaaggcatgtcatcaaattatttaggccaaacaagttgtaaaaatgtaaggcttgcaggaattcaggaaagggaatttggctagggggctgggctggaaagctaagccctgaacaatttagattttgacaaacacaaagaatagtccagatcagaatgaaatggctggaacaaaggctcaaaattataaaatatctgggatagtttcctgcacatagagaatcttcagtgctttttaaagctgttgactcctcagtggatgaatgggcaaacaacatttggtatatgtgaacacagtagaatactatgtagccataaagaaaaggagaaaatcctgtcatttgtgacaaaagggatgaacctggaggacatcgtgctgtgtgaaataagtcaggcacagaaaaatatcacatgatctcactcataagtagaatctgaaaaagtttatctcaaagaaatagagtagaatgctggttgtcagggtcgggggaatcggcgggggagggttgggaagatgtcgttcaaagaatacaacacttcagttagatgggacaaatacattcaagcactctattgtataacacgatgattatagttaataacaagatatcgtactctcaaaaaatgctgagggagcggatgttaagtgtttcaccacaaaaatgataattatataaggtaatttatgttaactagctggatttaatcattctacaacgtatataaatacttcaaaacatgttgtatgtaatagatacaattgtgtctgtcaatctaaaaagtaaaataataaaaaaaataaaaattttgattcaaatacataaagcatatatcggaaaatttaaacttgaaaaagaaagatggtggccgggcacggtggctcacagctgtaatcccagcactttgggaggccgaggcaggcggatcacctgaggttgggagatcgagcccagcctagccaaaatggtgaaaccccatatctactaaaaatatatatatataaattagccgagcatggtggcgcatgcctgtaatcccagctactcgggaggctgaggcaggagaatcacttagacccgggagacagaggttgcagtgagccaagatcgtgtcattgcactccggcctgggcaacaagagtgaaactccttctcaaaaaaaaaaaaaaagaaaaagagaaaagaaaaagaaagatggagaagtcattaaggaccaattttggagattcttgaatgacaagcttgcaagttccctatttaatatcccattttcccttccaaaaattcccagtaatatatttcaggtaaattgaagggcagttaaagattgagtgtgtaaacccgtagagtctctcttaagtgaataagggagaagacatctgcctatttaaagatacatagaaattaatattggttaacttgggtaagacataatatgattgttttccacaagtcactttgttccttatatagcaggaatagtttggctcttttggatcaaataactaaattgtcattacctatgctagaatcatgaggatgctgaattgaacaaagaaacaaaatggaaacaagataatctcttgttaagattatctcttggccgggtgtagtggctcacgcctgtaatcccagcactttgggaagtcaaggtgggtggatcacctgaggtcaggagttccagaacagcctggccaccatggcaaaaccccatctctactaaaaatacaaaaatcagctggacatggtggtgcatgcttgtcgtcccagctatctgggaggctgaggcaggagaatcacttgaacccgggaggcaaaggttgcagtcagctaagattgcaccactgcactccagcctgggtgacagagtgagactgtctcaaaaaaaaaaaaaaattatctcttgataatctgtataagaaagaaaaaatatatatgttggttccacctattgattaaatatcaggaacctccaatgctatagaggagattccttttaatgttgggtgatagccctacggtcatgaataagagatggttaggaagcatatatttaataggtttttcccttggttttattttatgtgttctgtcttggtatttaatgtgtatgtaacatgtctatttaatggatttaaactgctaaataattaatctgtgtgctgggtgatttactcactggatgggcaaacgccatagagagacttttatcttgaggtcagtatattggtaggcctggttatgagtacatcaaatggaagtgtccttgtctgtgactgaactatgacaattggcagtttatttttttcccaaggcaactcctcctagatcttttctgctgtcttagcctgagtcatggatgagattcacttgtgggatatatccctgtggacatccctgaggtgctgtacaactccctgggtgataaccatcattccactcctctcccccactcatgaaggtgtattacaattagagtaaatagagtcttgtaatcatggggaaactgaatcttctatacgtaacttaaaaagtaaagataactaagttaggtattttgttggtgaaaaaataacttttctaaagtaatagttctacccatgtttagtatttgtgtccactcagatgatcatattggcgatggggactgctgattaaattgccaaacttgaaatcattgggtaaatatagaggatagctaaggtctccaaagcaagtctgaggcaagtattcaggtatctgcaattcactgaaagagtgttctccaggaaaaacctgtaaggaaaagcagaataaggaagaaggaggaaccaaacaaggatggggtcttaggtaaagtctagcctaagtctaatccagaagggagatttctggaacataaactgtacctcagacccatttccaccttgagataatgaggctagctttttaaaaaatctccatgttaatcacttcctaagctacctcttaagtggggttccagaagtggtgggggtcaaaaatctttgattttgcttatatatgtgagaatattgtgaaaaaagttttttgattttacagtgggaggagccatccctaagggtgagtgggtatctgcccagtggtcttttgaatatgacttgacttttccaggactgtataatggaggagaagtagcttctatcctgaggaaattatgtctaatggttcagtatcccgggggttctcctggcctgtgtggtggaacacatctgaccctggcaggacactcaaataccatcaagtaactgatggcccaattaaagtgaggtgcaaccttgagcgattatctggttaatttggcatctacccaggtgattggctcccaaattagaaaaacattaaggctaaactaaaagttatttcatagggactttcacaagtgctcatctgcatctgatttctcaactgcctcgttgagccaggttacaaaataatcagatgtgctgagtgtgatcagcatcgaatgagaggacacatgcctttcttacccaactgcagtcatccaggcaagagctttacttaagttgtcatgaagaggggagctgtgcacttggctctcaaaagcaaatttggtgtctttatcaagttattgatcatatacgtaccagtagtaggaggatgtcattactcatcttactgtgaaaactgacagaattacacgtgaaagcctttgcaaacctaaaggtgtttataacaatataagaaggtttgggcttttttttttttctcttagtatccataccaaacacttagagatagccatgaaatcaccagtaaatcccagttctgtgcttctcaatttttgctgcagattacaatcatctggggaactctttactatcctgatggcataccatactcgttatcaactaattcagtctctgatcctaggacccaggcatttttccttaaagctccccaggtgtgattccgaagaacaacagaatttgagaactattgctttaattgatcaggtttaaaaagccattgaattttcctaaaatattgattatcaggctttatcgtgcatcacagtaatctagaggacatgttaatacacagattgctgaactctaccctgagaatttctgatatagtagctctagagtggggcctgggaatttatatttctaacaagtgatgttgatgctgatgctgcttatccaagaccaccgtttgagaaccactatcctaaaataggaaatctgtcctacacagagggcttttgttgttgtttttaaaaattgaacatagtctccctaccaaaacatctgattttggatcaaaaagcactctgaatccgaagtacccctgtatgagagaaagagcaggcatcagagattccaaccatggctgaaggccccatttcaacaagagagtgaataggaataaagcacacagaatgtcttgacagactaccatgtgaggcttgagctaaagtgctgcatggcatgactctggtagttaaagccaactgaggggagacattgaaagctgataaatattatgataaatattatgatcatcccttacatcaattcccccaaagaaatgcagtgagtcagagtttaaaatattactctagaatgcagcctaaggcatcactgagcattaatactttatatacaatcctataaccaaaatatctgaatcttctgtaaaactgctgtgaagagatgatccatcttgaagtccttagtccttttcataaaaatatttccaataaatttctcataaaatgtagaacttctctcttaaaagaagaaaagtttgcatcttctagtaaagaggcaaagtttttcatcagtcagtaagaaatatgttatttttctctttgcccagtctgggattaatttaactctattgtattaattctagtgagattgttttctacccttcccctgtttgaattgagtcatattgtaaatgtatttactactttatgtcttttaccattatctaccccaagttctttgaatttgtgaatgaataaataaatgaagtaactatttttccccctccaccaccttctggcaaaattgattgcatttggggagcctaatctaaggagtattaattagactgacattcaagatttggtagtggggggtgattcatcaagatagtcaaaagggaagccccagaccctttttccccaatggaccagttgccattgaaagaaataaaaccagttaagagatttctgcactccagtcaagtgtaaagccaatagcattaaagcactgtagaaaaatttatggcactcgcttgctggagcacctcccactccccacagcgtagcacagagctatcagtagaaaacttccaattcctaatttcttgctggggagggaaagaaaagagtggaaggtatatccagtgtttttacttttgagggggaagtactacctaagggagtggtttccgttttgcctgaatctaagtgatgacagaaactgggctatgtgggaggccccctgagaacaaagtcttatcaacatggcttggtctggtatcaggctgtaccacagacactaggggaggtccagtaccaacagagggaaatttaatgcttcctgcagcactagaaagtccacagtacctgataaagacaccaagggaagctcctgagtagaaaccaacaaatcttcaattaggggattacatacaaaagcccagagaagatgcatcatcagaaaaggcttgagagatttgcggaatctctagctggactgattgctctcagactgcaaagactaggagaagtgtctgattttttaaatgccagaattccagcagaagataataaagcacacaaagaaaccagaagacatggcccaaccaaaggaacaaattatatctacagaaatcaaccctaaagaaacagaggtatatcaattaccaaagaattctaattattctcataaagacgctcaaggaattaagagacagtacagatagataactaaaggaaatcaggtaaatgatgcatgaacaaaatgagagtatcaacgagataaaagatgaaaatgagcccaaagaaattctggaggtgaagaatatagtaagtgaattcagaatatagtactcaatttactagagagattcaacaacaggcttgaccagacagaaaaaaataatcagcaattcaaagacagaacattagaaattattgaggcagaggagcaaaacggaaaaaataagaaaagtgaagaaagctgaagggtctatgggacatcatcaagtgcaacaatataagtgttatgtaatttgcagacaataaagagagaaaatggcagagagcctatctgaagaaaaaatggctgaaaacttcctgagtctgagcaaggaaatggattcacaaattttagaagctcaagaactgcagctaggatgaatccaaagagatctacactgagacacattataatcaaagtgtcaaaagtcagagaccaaaagaaaatcctgaaagcagcaagagaaaagcaacccatcacaaacaagtgtgcatctgtaagattatcaacagatttttcagcaggaactgcatgctagaagggagagagatgatctactcaaagtgctgaaagaaggagctgccaatcaagaatactatatccggtaaaactgtccttccaaaatgagggagaagtggagactttcccagataaacaaaagctgaatgagtttatcaccactaggtttaccctgcaagaaatgctgaagggagtccttcaagttgaaatgaaaggatgataaacaacacaaaactatatgaaaatttaaaactcctagataaaggtaaacatacagacaaatataaaatcctgtaatattgtaggtacaaaaatcacttttataaaaatctggtatagaatgttttaaaaagtataaaaggtaactataaatctatgttaataactgtacagtataaaaggaggtaatttgtgtcatcagtaacaaagtggggcagcaggatgtaaatagtttttatacatgattgaagttaaattgttgccagcttgaatagattattataactttaagatgtgctatataattacagtggtaaccacaaagataatatctatataatatacaagaagagaaatgagcagtgaatgaaaacatatcatttttaaaaataaaggaaacacaaggctgggtgcagtggctcacgcccgtaatcccagcactttgggaggctgagacaggcacatcacttgaggccaggagtttgagaccagcctggccaacatggtgaaaccccatgtctactaaaaatacaaagtttagctggatgtggtggcgcatgcctgtaatcccagctactcagcaggctgaggcaggagactcacttaaacccgagaggcggaggctgcagtgagccaagatcacaccactgcactccagcctggatgacagagtgagactctgtctcaaaaataaacaaattaaataaataaaaattaaaacaaataaaaatcgaggaataaaaatctcctcttttgaagacagaaagaggagaaagggtaaacacaaaagctacaagatacataaaacaaatgaacaaaatggcaattgtaagcccttccctatctctaattattttaaacataaattgattaaatgccccaattaaaagatatagcttgactgaatggattaaaaacaaacaggatctaactatatgctctctgtaagagacacactttagatctagggttacacgcaagctgaaaatgaaagaatagaggaaaataatccgtgcaaaccagaacctaaagagagcaagggtgaccgtattaatatcagacaaaataaactttaagacaaaaactgtcacaagagacaaagaaaaacattatataatgataaaaggactgattcatcacaaagatgtaactgttagaaatctgtatgcacctaatattagaacttccaagtgtatgaagcaaacattgacagaactgaagagagaaatagcagcacaatagtaggatactttgatactctattttcaatcatggatagaacagtcagacaaaagacaaataaggaagcagaggatgtgaacaaccctgtaggccagttggacctaacaagcatataaagaacactgctctctactacaacagaatatgaaatctactcatgcacacatggaacagtgtccaaaagagaccatatgttagggtacaaataagttttaacagatttaagaaaattgaaattatacgtaatatcctctcggactatgacggaatgaaactagaaattgatagcagaggaaaaacgggaaatccacaaatatgtaaaaattgaacaactcattcttaagcaatgaatgggtcaaagtagaagtcacaatgtaatttagaaaatatcaggagacaaatggaaatgaaaatacaacataccaaaacttacggatgcagcaaaagcagtaataagagggaggttaataatgatacatgcttacattaaaaaagaagaaatatctcaagtcaatgccctaacttcgcaccacaggcaactagaaaaagattttaaaaactgaaaaatcagtagaagtaatagaataatatatattagagcagagataaaggaaatatagaatagaaaaatactaggaaaaaaatcagtgtaaacaagagttgatttttaaaaagatcaaccaaattgacaaacccgtagtagactgagaaaagagtgtactcaaataagtaaaatcagaaattagagacatgaaacagatgattcagaaataaaaagagtataaagaccactataaataattattcactgaaaaattggataacctggaagaagtagataaattgctagaaacatacaactgcttaagactgagtcttgaaggaatagaaatgtgaatagacttagaactagcaaggagattgaagtagtaatttaaacttcccaataaagaaaatccctggaccaaatgcctcagtggagaattctaccaaatacttaaagaagaattaacaccagttttccccaaacccttccaaagaattaaagaagtgggaccacatttaaactcattctgtaagcgcagctttatgttaaaaccaaaaacaaacaaggacagaagaaaactacagaccataaccctgatgaacattgatctagaaattgtcaacaaaatactagcatactcaactcagcagtacattaaaaggattatacacaatgtcaaattggaattatacctgaaatgcaaagatggctcaacatacaataatcagttaatataatatactgcagaatgaaggaccagaaccacgtgatcgttccaattgatgaagaaaaagcttttgacaaaattcaataccatgtcttttttgtttgtttgttttttcactctgtcgcccaggctggagtgcagtgttgtgatcttggctcactgcaacctccacctcccgggttcaagcgtatctcccacctgagcctcccaagtagctgggattacagacgcatgccaacatggctggctaatttttgtatttttagtagagacggggattcaccatgttggccaggctggtctcaaactcctgacctcaagtgatcctcctgccttggcctcccaaagtgctgggattactggcatgagccactgtgcctgccctaattcaataccttttcatgacaaaaacactcaacaaagtagagaagcaaactacctcaacctaatgaaagccttatatgaaaaattttacttctttcctttccaatttggatggcttttatttatttacttacttattctttgtctaattgctctgcctaggacttaatactaggttaaatagaagtgctgagagtgggcatccttgctttgtttctgatcttagagaaaaagctttcaatttttcactgctaagcatgatgttactcatccactttacagtcagaaaattaaaaatggaattaccatataatctggcaatcctaacatttggtatatattcaaaataactgaaaacagcatcctgaagagagatttgcacacctatattaattgcagtattattcacaatagtcaggaggtggaagcaacctaaatgtccatggatagttgaaaggatagaggaaatgtgtttaagtacatacaatggactattatttctgttatgtattacaacatgaatgaaccttgaggacattatgctaatgaaacgagccagtcacaaaaagcaaatacttcatgattccactttgtgagatgtctaacatagtcaaactcatagaaacagaaagtagtgttgttaccaggggctgggagagaggaggaggaaatggggagttgggtaatgggtatcaacatttagtgttgcaaaacgaaaacattctcgcaatgagttgcacaaaagtgtgcatatagttaatactactgtactgtacatgtaaacattgtcaagatggtaaattttatgttatgtactttttttttctttttctttttttcaatttttttagtatttattgatcattcttgggtgtttctccgagagggggatttggcagggtcataggacaatagtggagggaaggtcagcagataaacaagtgaacaagggtctctggttttcctaggcagagggccctgcggccttccgcagtgtttgtgtccctgggtacttgagattagggagtggtgatgactgttaaggagcatgctgccttcaagcatctgtttaacaaagcacatcttgcaccgcccttaatccatttaaccctgagtggacacaacacatgtttcagagagcacggggttgggggtaaggccatagattaacagcatcccaaggcagaagaatttttcttagtacagaacaaaatggagtctcccatgtctacttctttctacacagacacagcaacaatctgatttctctttcctttccccacacttcccccccttccactcgacaaaaccgccatcgtcatcatggcccgttctcaatgagctgttgggtacacctcccagacggggtggcggccgggcagaggggctcctcacttcccagtaggggcggccgggcagaggggccccccacctcccagacggggccgccgggtggagacgctcctcagttcccagacggggcagccaggcagaggtggcgctagacgtctaggtggcacttcctagacggggtggcggccgggcagaggctgcagtctcggcactttgggaggccaaggcaggcggctgggaggtggaggttgcagcgagccgagatcacgccactgcactccagcctgggcaccattgagcactgagtgaaccagactccgtctgccatcccggcacctcgggaggccgaggctggcggatcactcgcggttaggagctggagaccagcccggccaacacggcgaaaccccgtctccaccaaaaaatataaaaaccagtcaggcgtggcggcgcgcgcctgcaatcgcaggcagtcggcaggctgaggcaggagaatcaggcagggaggtcgcagtgagccgagatggcagcagcacagtccagcttcggcatcagagggagaccgtggaaagcgggaggcggagacgaggcagagggggagatggtggaaagcggaatagggagaggaagagggagacggagacggagaggtgtactttttaccacaatttaaaaaatagaagatttagcagtatttttcaaacttgaagactcatatgtattacttgggaattttgttaagtttagattccaatttcaggtctgaggtagggcctggaattctgcatttctaacaaacttcaaggtgatgccagtgcttctgctctagggatcacattttcagtggcaaaaagttgtgaaatcatagatctcttctctgtcttgtagtggatggagttccggagggtgtacatttaacaagcttctggtgatttttatggtcaattaaattgagtttatttgaggtgccacagatctgtaatctgctttctagatccctttcttacccattcttaagccatcacagcagagtacctttctaacttataagattgtgtagaggttggaaggaggacaggactgttctgttggtataatgaccctgtgtccagttaatccatgcttccattgctacattatccaagagtgcaacatgacccaacaaaacctctatcagtcatgtgaggcattttttttttaacagaagaagagcattggcaccaacaatattccatctcttctttttccagcatgagaagaccatggttcttctagactcctaaagaaagtcatttgtacttagtgtaaggcgtgttgcttttggtaaagtcttttgaatgtgatgaaaatgaacatagcacaaaggcaaaatatatgctctcattgcctgcaaaactgtttctggtgctttattgaaagagcatgataagcaagatatcagtcactgccgcattgcataaacatagctcttctacattgtaatatggttctggtgagcctgcatgtctagaatagagcctgtatcactgaagtgcatgaaactgctgtgataacttgtctcacaaagcctcagggaacacattatttgagcaagtaaactcaaggtgaagttcttaccttctcagtcctgggtcagctgttggacatactggggaggaaagaggagaccatgtgcttctgccgaacaagacccaaatctggggaaagctgaacttccagggtgcacttgccctgttaccttctcctaagtacatgttgtgggaaaagtagggaaaggcggttagctgctagagctagctcagcagcaggagctcattctatgtatctcttctcaacccagcgttcagtgacttcatgttgatagcttgaaattggccaaggtaggaatatttacaccacagaaattggcaaggactacaaaccaaattctttggtgttttattttattgttttgttttatttagagagccacttgtaaaacatttactatcacaccagttcagatgatttagtagtataaacagcccatgtggtatttcttggataatttgtttcattagactgaggtacaactccaaagaggatgtcatgtcctgtacacaggactggaagttcacgaagccattcataaccctatatgaaggggagaaagagatgtagtgttcaggcaaagcctcatgagacgggaatttcctgttttgaactgaatccctgatttctttcctgcaacatacattcattcatcaaatattgattatcaacttttttataatacacaaaagggaaagaggctcttacttgaattatgccagaagtcagacaaaagaaagattgttgctttttggctggtcatggtggcttacgcctataatcccagcactttgggaggccaaggcagtaagatgacttgaagtcaggagttcaagaccagcctggccaagatggtgaaaccccatctctactaaaaatacaaaaaaaaaaaaaattgccaggtgtggtggcacacatctgtagtcccagctactcaggaggctgaggcaggagaatcacttgaacccagaaggcggaggctgcagtgagccaagattgcaccactgcactccagcctgggtgacagagcaagactctgtctcagaaaaaaaaaaaaaaaaaaaaaaaaccagatcgttgctttttaaaaattgacttaattcttcaataggttcattgattaaatatcaactttgtatcaagcaccgtgccaggcccaagggatatacagatccaggatacatattcttgccttcaaggaactgatgttctaataatagctaataacaagagctactatttcctagctactgaaattctagggttctcactatcatagtctaatgactctcttctgttcatttagcagacttcgcatactgtacactacctgcataaccaaggacttgagtttgtataagagtttaagacactgacatgtaaatgaaatatcaccaatttggactgatataagaaagtcgatgtgattacagagtgtttaaaatgcagactgtcttattatctttatatggataggatgggtcaaaggaggttaacaagaatttagcagctgaagccctacttaaagcattatataagaattaattttaatcaacatgttgattatataagaaataatgttctaaaatgtctttaaaatatttttctgggaataagagaaaacctccacctatgtttatgtaactgatttttgagttttcaagtcttttataaaaaaaaataaaaggccatacctaatcctacttgttggcagagaaagatgagagatcttgaaatggctcccgtgctcaaagtatttgtcagttttcatagagcccgaagtgccgatattgaagatgtatttcttatccataccagcatgtaatactcagcaggaaaaaggaacaaaaactccaaaaggtcacatactgtatgattacacaccacacacacacagactctctctcacacacatatgtatctaaaacattctcagaatgactaaactatagtaatgggaagaggtcagtggtttccaggagttacagaggggaggtagaaggaggctggatatgactgtgaaggggaagcaagaggaagatccttgtgacaatagaatagttccctatctcagtttccatggtgcttttgcccagtctacatgtgtgatacatacacattataccaagtatcagtttctttgtttttgtatttaactgtatctacataagatgtaaccattgggggagacggggtgaaggatgcacaggacctttctgtattatatttggtactttctgtgggtctataattatttcaaaataaacattttctgttttcaaacaatgatgtgtttctcggactctaagaaaattttcagcagaagaaaagtccgtgataatggtgactggggtagtgcagtagtggaaatagcagtggagaggggacgtatgaagttcttaatctggatcaaatactgtgctaagtactttatgttcaatacatgtattattttatttaatcctcaaaataatctcatgattgtaaaattcttttgtttcataataacgcccaaaggaataggagtttttaaacccaagagctgcccgtggaagaagcattattagagccatcaggaaacagggcattcagtgaattagaccgaaacaatagaaggatggatattaggaacactagaaggggcacatcatgctaacatcaaaatggaaaaatcatctacttcagagttgtgttgagagtctccttgtgaatatcattcataataagagagcactgacttgttttttaaaagacagggtctcaccgtcaccaaagctgcagtgtagtggtgtgagcctagctcactgcagccttgaactcctgagttcaagtgatcttctcacctcagctttccaagaagcaagggctacaggcattcaccactacacctggctaatgttttattttttatagagactgagtctcactgtgtcaccgaggctggtcttgaactcctggtttcgagtgatcctcccgccttggcctcccaaagtgctgggattacaggcgtgagccaacacacctgacctcagagaaggctgatttttgaatcagccattctaaaacagtggacctagaaagaagaaatcttctaccagtagccttctttctagatagcaatccaacaggccaaaagaaatttggggtctcataatctgataccaatattttctcctcagtagtgaaaagatttgaattaatgcatttactctaagcttgtttttagggaatgatgaggtaatagttaaagaaagtagacaacggttaaagtaataagaaatgctgaacttccaaaaaagctggccttaatattctccatcaactggcagtgttcccagtgatgcttctatcacagactgtgatagaactggcattacacaataatcctttcttcttcaataatgtagtaagacatcacatccatatatttcccaaataggactgccactgcatatctagttaaggagctatcattctactgtttctcttgagaaatgacactaaagcaaaaaacttttaagtttttgaggggttctattggccacttaaaatacccttgatatatgaccaaaattcatttaactaactaaaaacaaatagttgtgaattacatagagggcttctctcagccagatgcttctcatagataatctaataaagatcattgaaaaataataaaaagttgcatttctcacatggaggaggacccataatacagttcattctaatactgagggagtggtgccctctagcagtgcatgtgagaaatattatcatttaagtatattaaatacagcaaataaggagctcccagtatctcagctactctcagacataaggggcaatttgacagttctgagctactagaaactactgaagtttcacttccatgtgcactaattttttaagtgccagcgaaggttagattctaatagtgcccttctggggatttaccaataacttttaaaacctcattacctgtgaatgtcaaatagaacaggtccctttcacttttccttcaaacctcccctaggtcagtgtttgaggatgagaataaagggtacaaataggaaaaaggatcatcctacaagctgaacagcatctctggtgcaaaagatgctcacaaaatgggagaatgttaagaaatccattaatagctcaagtattcaaaaactgatggagttctgacaattttcccttaaaagtaccacagtttatggttacaactgataaatttgcagggttagataacttcagaagctaattaagtaaattgagttaacaaaagaaaagaacttgattttttttttttttttttttttgagacggagtctagctctgtcccccaggctggagtgcagtggcacgatcttggctcactgcaatctccacctcccaggttaaagcgcttcttatgcctcagcctccccagtagttggattacagaggtgcaacaccacgcccagctaattttgtatttttagtagagacggggttttgccatgttggccaggctggtctcgaactcctggcctcatgtgatctgcccacctcagcctcccaaagtgctgggattacagacatgagccatcatgcccggccttgaatttttaattccattttaattagtgaaagatgttccagccagtcttatctcgataagatatccaaaagattatatgcacaccaatagtacattacaaatgcttttgaaactgaaaggtgtgttttctggtttctgtgtgtctgatatgctatttcaaatcctgtaaaagcaaaatgtagttttttgacaaatatgcccatgtgttgtgcacagtttgatttatgtaaactcatttcaaatgctactgcagaatttctcctgaatggatgaaaaatgtccgcctaaagtgataaaattatatgtgtagaaagatacagttttaagaagggatttttatatgatacagatttgtaactctatttcacaaaatatcatttaaaaaaaaacttcaagaatacctgactttttttttttacatttttctgtcagttcaggggtttgcattgagtttgctctgctgaaacacttttctgtgacttagcttatatgggattggtaagtaggggaatgatgtcagtataacatagaccctggatttgttcaggtattttactaagtagcagcaaccaaacacaaagcctacgaacacagattaacacagctagccaagggaaaatacctactgcacatgattcccattcatgccacattcttcctgttggtgcagtgtggccacgtactccaacatgggagtgcttattgcgtaattctcaatctttctgcaatttgcacttatttcatagcttagcaatctcaactcttccttctttcttccatcaagctaccttctcatgcatgtgcacacacacatacactgtattttttgtagtagttattatgaatttaacttatctttttaatcatgtttatatttaattatgtttgataattactaggatggttattgtttttgtagtgttctcgttacataaatattgagtaggtgtcctgaccctatctttttcataaaccctacaatttttattgcatgattttgcagaccatagaagaaatgcgtttatctcattaaagcaaaaacatctgtacatctgtacttgcactctacttattaattgcacttattatcattgaattactcccagaattatagacttccctcataaatctgaggtaaacagattgagatatcaattgcctactagattcatttttaaaattttaccttcgcatgagaataccagccccaggtgtacattgcatggccctattaaaaagtgacctctccatctttatttgtttctaggcagttaccgaaagtatttccacaacaaaagaatgtaatcaagatttgacttgcttccactgaagcttactttcatttttaaacatcattagcctatgatttaggaacttttaagaaattggcccccattaccccccaagcccccgcattcacataacacacacctcaagttctcctttaagtaatttgtgatttatatttcaattttacattcaacatggtcttaaatattaaattccaccaggtcaaactgcaatgagtcaggcttttaaaatatgataaaattaagattccaagaaatgaatccttccattccaaaatctcttcttgcacattaattcaattaactcagaagaaaatagatattttccaggaaaaatgtcttttattttacttttgtgcgaatacaaatatgtatcttttgttttaggaaagaaataattctctgatagtatttccataggactatgttactggtgttagcatgagtgaattttttagaacgctagtggtgagcatataatagagctatctcaacacctacactccaagaacaagtcacagcttctcctaaatgagccaagcattgcattgggcacttgcagtgaaaagctaaacaaaaccctgtgtttaagaagcttacggagagtgacaatagagacagttcagcatgttctctaatagagatatatatgaagagtgctatgggacaaagcagaggtggcgaccatatcagagagcaaatgctttaacctacacaattaaaaaaaaaaatcttatggcgttcctaattttgtttctttccctttcaattttctgaaattttaaaatgtttgttcacttgaacatacaataaattttctttaaaagagtccctcaacagggagatgagaatattctgtgtcttgatcttcatggtggtgtataccaaattcaccaaactgtacacacacaaatgtaccttttaccaaatgcaaattatacctcaaagtttactaaatccatcaaaacatacagtgctacatactttaaaaaaattagcttcctccctttgatgaccaaggtagcaataagtgtattagagaaagaaaaagatgctgggtgtggtggctcatgcctgtaatccccgcactttgggaggctgaggcgggcggatcacgaggtcaagagctcgagaccatcctggccaacatggtgaaacgccatcactactaaaatacaaaaattacctgggcgtggtcatgcgtgcctgtagtcccagctactagggaggctgaggcaggagagtcacttgaacccgggaggcggaggttgcagtgagccaagattgcaccactgcactggcaacagagcaagactctgtctcaaaaaagaaagaaagaaaaagactaaggaattatctcatggaaggctgtcttgcataataattattttttgtactgtctttcagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaaggtactgtcttgaattattttcaatatttggttaacctgtaaaaatgtgttggtctgttattaataattctaaggggaaggtggggtgactatctgctgttcctgaactaagtgttaaaaaaagaacagaagctttggaaggatgagtggtaagttattgatctttatagtccttctggatttgggaattctacaaagcactccgtgcagagatagatcacatgatccccgctgaagactgccagagctgcctgaagatgaacagttagaaacatcctccttaatttaagcctgaaatttttgtagatttccccacctttccccatcctaagtcctttggtatatgtaaataagcccatgtcttatttgctatgacaacccttcaattatttggcagtggctattatgtctcctgttagtttctccttttttgaggctgtctcaaaactcattcaaaactcattcttttcaaaactcatacttcaaacagcagagtgttatgctttttatttcaactacatatttttgagaaaacaggttttttttctaatatctaaactcttcatctgtatatttcttatacatgaattacatttagaatgcatgtagtgtatacaatgcaaatatataggagttatttgaggttttacattagcttgcacgaaatggcaggtgtctctaagaccttttcttggctgtcacccctgtaaaatatcccctacctttttctataatctacttaatctgttgcaaaatggtaattatgcgtgaatctgtttgtcacctataagacaggatttgccagctgtatatataatgattttaattaatgctaaaggtcaggtactcaaggatgcaagaaggaagcctataaaaatgtgtacgtatctaccctttacacctgtacacctttggatttgcatatacatattagacctgatgatgatggtgttgtccattttaatgtaaacctgatatggtttataaatggtgtattcatactttttttaacacttgctatggactaaggagtaacaaatgtattaaatttgtggtatacatccctttctgatttctggtgtatcaagaaagcagtgtagttcattgaatgttgacatggcattcaaatttgtagccaaacctgaaaatcaatagcataattgcttattttgcagtcatcaacatgagattcattttctgttttatttacttcagtgtttcttaaaatgtggcacgtgagattacttttaatagctatgtacttacttttaatatagttgaaatataactagtatgtaccacatgtatttctcagaataaggctacattttaaaagttttaattttaaaatgacactaagaaaataataatatgggtattagacatgtcaaaaatcatgaatgaataaagttataataacactgtaggtcaatcaggagaagctaagctatgctactgtaacaagcaaccctgagttctggcttataacaacaaaaggcaatttctcttttgcacctagtgtacatcaggggtttggtagtggctctgctcctctctaaggccagcctggtggaccaagatgctctggacgttgccattgcagaaggaaaagagccaaacatgcatgggttcttaaagcctctacttagaagtgcaacacttgcactttcactcacatttcattggccaaaacaggtcacatgttcctgcaactcagcagggaaatataatcttgctatgtgcctggaagaaaagagacaacctaatattttgaacagtattaatgactgcttacaactgctacagcttaaccattgttacaagctaattaaattacctttggggaaatagtatgccagtatcaagaattctatatgatatgtgaatttaattgattgtttccaccacttgacttaccacaaagcttgtctttatccagatttcattctatctattcctgacttgactaataaggtccaaatatgcttcaacatttattttgcactaaaatatatatttaaactgaggaaactccccatcattacctaattcctgctatttatcgcctccaccttctctgtcagcaggctagtcccaaactatcaatattagcacttattctccacatgagtgctgtgttctcacagttctgatcctcgttcccacctcactcagaatgtattaaccagatatgatgattttgttaatgtaaatgcattaaaaaactggccaggtgtagtatataggggaatgctggggacttcagtgtttgccccatccaagggagacacctgccactcagccatatggagacacaggtcaggtgcctgctcatcttcttgttcttcaagagaaactagaaatctagacttttgtttgagcttccattttttaaatgtcagcaactaatttttattttgatgatgtacaatataaactgtgtgcttatagaccaagtttacttcatgagccacgggtttttaacttctgagaacatgaagtggaacatttcatagtttctgaaatgggtgaacaataagaaagattttatgattgttttctcattggcagagaagagattctgccatttttctcatttctttctgatagagaagagggaaaattaagtggatgagtgagaaaaagcaattgtagatgaaactgatgagtaaaaaattttagaacccctattttgggaaaggattgacctggtagaccaacatgaagtgcaaaattctttgactacacagctttgagtaataatttctaatgcactgcctcattagccttaattctcttttcagatgtagaatcttaggaaacaaaaggcaagtctttaacctttgattaaaaatattattaatcccttaagtaaaaaatactggcataacacagtgaaacaacactttatgatcaagccccttttattaatgttctgcctagattctgtgttttgaaagactttgctaaactcttacttattgacatttaatttcaattttaattaatcaactgcctacaaatgagtttacagtagtggtattagaagcaatattttaaaaattaaaaaggttttgtctcatctaaccatgtggtgatattgtagttagctaagtggatatagattcagaaacactggtttaacattaacatgttcgttatcttaaaaatatgtttaaaatatgttattgttttggcttcccattcttttggaaatatacagcatattcacactagccttatctatgttaatccaagcatctaaatgaaagattgaaaagtcaagtaatttcatagcattcttcttgggtaagcagaatatccataaacataaaacatttcttattgtcttgtgtgtgtctccagcaatcagtgtaggcaatatcaggcatttaaaacagggaagacctgtcacacagctcaagagctttagtcctcaggagaggtctctagtcaccataaaggcagttggaatcatttggatgaattgaggaattaagcctactaactgaataaggttgattattttatttactgttagtttttagacagaaggtactttgaggcaggtaagactgaagttgacctattaaaaacaaaaacattaaaatacagaaatagcagaatcattaataaaaatcctagaatcctaggattataaggagctatacaacaattgtatcaacccagggtggatgcttttggttacaagtaagagaaacccaactcaaaaggacaaacgagaattcattggctcatgtatttgagaagatccaggatggattgcaactgcaggtatgacagggcttaggtgctcacacagtatcatcaggactctgtctcgctctcttcctgtctcacctgcacctttggctgttttggcttcttttccaacaggctctcctctcctgctagtaggatgactactggagccatgtactcaccctcttttccaatgtatcgcaatgtccactgatcaggcagacgtgagtcatgtgcttatcctaagaggcacatggggaagcccatctcaaaccacatggactgagaatgggacaggggttttcccaaagaaatcgagctgctatcaccagaagaagagggaatggatgctgcgcagaggctgatgccaaactcccaccataattacagagcccatcttccatgccagggcagggatccccacaatggctgggcccacatccttccctggttactaataatgatggagaccttactaattgttagattatgtccttgcaacttccactcatttttggtttcactttgtggaattttactgacaaatcagattgttctccaccacccctcccttccctttctatactgggaggctaccctatgttctctttcaattcttttctaagcccagatgtcccccttgtatctgattttcttcagacagcgttgtttggcatcctctcactgttttggtcatttccaagcggttttaataagggaaaaagtagctttatttatctccacagaaaaggatgatgattattattgttatactagagagaaaaaatgaccttcagcgagtttggattagtaaggcaagcaagtgaatgatataacatagaaagaccactccctgccaatgtttatttttaaaaattaatgtggtgcttagacaagaaagtttagttgtctggaaaaatcactgagacaaaatattttacttttcaccgaagccaaataaattaataaactgtcactctcattaatgttgagtaaataaagtcttcttattcttatgcttaagggtttccccccacccttttaaatattagactaatacattatgtcaagcaaatggataataagcaggtataggtacgccactgaatttttccaaaaagaatctcacacctacagtctgcatgtcgcaggcttgggtttagaacagcagcatgactctgttttgtgaatctagccaattccagtttcattccatggatgcagcactcactgggtatttacctttgcttagcactagagagagagaaaaaaaaggagacatgaacctagctagccctcacggtgctcatagactagcgcagaggcccagtagcacaatatcaatataaatttttcaacaatcctgaggcatatgttataaaggtgatgtattgagaaggactactggaaaatgtagggcagcgatagattgtggaggccttgtattttatgtctgtggagtttagacttgaatcagaagaccatggacagaattgaaggattttatgcaagggagtgtgcagtcatatgcatgctacagaaaaattactgtgcctgcaacatgcagaaggaatcagggtagggcaaggttgaggatgcagagagggcaattccaggtagcagtctaggaagaaaatcacaacacgtggatcacatcagtctcctgagagtgaaagagagaagggtgatatacggactattaaagggtagaactgaaaacacttaatgacctagtaagtagaaggattgaaaaaaggaggaggaaaaagaggaaatgcctcctaggatcccatctttaggaactgacgaatggcagttcctaataccacttgccgcagtagtaaacagagaaggagcaagactgagagggggcaaataaagaggttactgttagcatgttgaatgtgaggtgcctgcaagtggtgacgtcattcaaacggggattcccattcaagtgtcacctgctcagagacacttttcccagtaacatacttaaaatggtaaaaccctcaccttcttttcctaatttatatattttatagtatttgtcaccatcccacatactatgtattaacttttaattgtttatttatttattattttttagagacagagtcttgctccattgcccaggctggacagcagtggtgagattatagctcactgcagccttgaactcctgggcaaaagcgatcctcccacctcagccccctgagaagctgtgatcacaggcacatgccaccatgcctagctaatttgttttgttttgtttcgttttgttgcttgtagagacagaggcttgttatattattgcccaggctggtcttgaattcctggccttaagcaaacctcctgtctcagcctcccaaagtgctaggattacaggcagaagccaccacaccttgcccacattttaaccttatcatcgatcttctccaccctccacccattggatcgtaaattccatgagaatagaaatgtgtgctgcatgtgcgtgcatgtgtgtgtgtggccggggtggggggtgggagtttggcttaaacagtacaaatttaggccgggcgcagtggctcacgcctgtcatcccagcactttgggacgtcgaggcaggcggatcacgaggtcaggagatcgagaccatcctggctaacacggtgaaaccctctctttactaaaaatacaaaaaaattagccgggcgtggtggtgggcgcctgtagtcccagctactcgggaggctgaggcaggagaatggcgtgaacccagaaggcggagcttgcagtgagccgagattgcaccactgcactccagcctgagtgacagagcgagactccgtctcaaaaaataaataaaaaataaaaaataagtacaaattgagattcttatagttctggagataaaaattctgatatgggcctcattggtctaaaatcaaggcttcagcagagatacactcattctggaggctctaggggagaatctgtttccagcttctacaggtcacctccattccttggctcgtggtcccttcgctccatcttcagagcttaatgaaaaagtgagggaggcaagtcttaatcggtagaggtttatttcgccagggttgaggacatggctgggaaatacatacgtcactggagcatctgttactggtgctcttccaaaagggggtttgaggatttttcagtatttaaaagggaaagagcaagcaagagagaaaaaaaaggagggagggtggacaaagatgcagatgcttacagtctttatttatttatttatttatttatttatttatttatttagagacggagtctcgctctgtcgcccaggctggagggcagtggcgcgatctcggctccctgcgagctccgcctcccgggttcacatcattctcttgcctcagcctcccgagtagctgggactacaggcacccaccactatgcccggctaattttttgtatttttagtagagacgaagtttcaccgtgttagccaggatggtctcgatctcctgacctcgtgatccgcccgcctcggcctcccaaagtgctgggattacaggtgtgagccaccgcgcccggcccagatggttacatttttatgaggctgtgatcggcctcaggaaatgtacattttacgtgtgaaaagagggcatcaaggaaaaagtcagttatgcattcgtcgcagggtcagccaagggataatttctggttttgtccttttcctctccgtgggaagataagctggtaattgacgttgtcagggtgagattcaacggaatttggttttagggctagtttatacaggggatatgtatcctgaaagatttaggggctcacaaggaatttcatttgtgacgcaggccatctggggagatacgtggccttctgtcattgtgggaacctggcttatgggtgaggctgtgatacagggttgtgaaattacagctatcggtctgggaacaaaaggaaagcagtgttgcgtgactcagttcccaagcttaactttttctttggcatagtgagtttggagtcccaagattctattttctttcacgctagtaaaggcaagttcttcccccatcccaccactctgacctctcttctgcctccttcttccattttgaaaggccttttctattgggctttctgtatatgttttattccgttctttaacactacaacactgcctggcatagcataagtgctatgtgagtgtccaataggaaactggaagtatagatctgagttctggaatagagacagagatacagacatcagtagataagaagccatggagtgcattggagtgcatatgttcatccagagagagttctacagaatgagaacatctatggctcaaaggaaggtaccctgaggaacagacacattcagagaatgagcggaagccacgcctgctgggaggtttgaaggagactcaaagaggtgggagaacatctaggagaaagtaacaaacagaagccaagggagaagaaaggtgcaacaaggagtaagcgcttggtgcttccaagaccctcaaaaaaataatggtgcaagcatgactgctggatttaggaaccttaacgttaccttgggcagagtacttttaggccactgtggaccagttttgaagacacaataaaattgtataaacatccatattcttaggcatgtcttgccaaaccgaaatacatgtttaggtctgcctgacccctgcagtgtaatcagatcaagtctagcattctgtgaaaatatccaactgaaataagaatgaaattcatgctcatgtgtcttgtctatagacactggtatctgcctccaaagtgaaattggatcataaccctaatttgcctctcttcccaaaggcttttggaagagttgaaattcatgtaagacatggaaggaaatcccagtgcagggctgcacaactctgtgttgcacacaaggtgtgaaacccaggtccaaagacgctggcagtctgggaggcaaagcaaatgtgatggcaggtatttgcccagaaggccgatggaatcctggtgtggaaagtaaagtttattgcttcaggcattctgtctctgttctggaggcagagtgtctatatatgtgctcttaatgagaaacctgccctcaggatatctcttacagttgctgcagagctataaagctctgttattaggaattctgccctggggaacaattatgttattgcaataattagaggcagttcatctccataataatggaaatcctgccttgtaggcaaaacaacatcaaagcaacaggagcgtcattgctctagttagaatctgctgccctgcttattggtagtactatcattttaattttgcacatgcagttacgaaagagagcttataccgctcttcaaattcagacctagaacttcttgccgttacttcagtttgtctctcctagagccatggataaaatagttacggcgttgagctctcctgaagtgcagttgcaaaagtgtttagggagattggtgttttaaaaatgtttgtcagaatccacaggcccagtcctctgggagaccccataaacttaccctcagccaaagccttttctatgtgggtatagtatggcatgttattttatggccagggttaaaatgatgactaaatccggtgactacctgagatgggtctgaccctttgctctagtcatgtggcatagtaataccagaagacatacatgtggttatataactcaagacatatatatggaatttgtatatgaagctgctttttaaaaagtgtccaatctaaaggtaacatttgattttcaaaaaaaaatcttttgaagtgtctcacatattaatcccttccttgcaagtaagtcctttgccactcccctggttttcaggccttattgtctcttgtgtgaattttgcaatgattcaaccaacctcttaaatgatttcattggaaccagccctcacccaaatcttctacaagatgaaacttaccacaataaacctctgagaaattcaattgaatgaatatctgtcacgtatctccctggtacaagatgtatttgagattatgaacataacctaatttaaatcaaggttctacatgtgtcacggaaaagggacgaaacagtttcttccatgatttaccagagacttttttttatcttatcatagttataaacttcatatttacagctattggttatttaattaatgttcattttccctaagaggctgaaagggccatgctgaaaagtgccatttgtgttggagcatacaggttccccagttccttgtgctatacctagagtagaatagacactaatgttcttgtatgaaatgaatgaaccaacccaaatcgtctgattcttggaggggattgaggagaaggtggtggtagtatatttaggtgcaaggagcagcgggaaagaaatgtatttgaaaggaaagtagagtgaaaggtttgagcaggaggagataaaactgggacatctctcagaatccagttgagaaaagcattccatggcaagctaagaagctggcatttcactgggaaacagagtgaagtaatgattttgtcttggggcttcacacttccttttaagttatctcctgtcctccatcggttgagttcagtgtttgtactcaggtagtgtctgccgtgacttaccatgcacccacctgggaaagcatttcaacttcctaaggcagtgtttctccattcctagagcaaagatccagtggttgttcccaaatttaggtctgcagctcagtgccaggctgactgcagcaaaatcaactgagatgtgttttagaaagcagagtcccactctccatcttcaaagatgctttctcgggaattctgagatggggcccaggaatcagaatacttgtttcccataggattttaatgcacactcaggtatgacaacgtagcagtggcttcccattgacttcaggatagacactaagtcttatgagatgaccagtaaggctctatatgctactcaggctcctgcctgctgtctaccagctgtctcacttcactcacctttaccctcagtttttgagccacacggaccttctctcttttcttcaaatggcttcttcttcctcttgctgcaaagcctgagaacgtgctgttctccttccctgaaatgctcttatccaggccttgaaaaactaagtccacaggccacatccaaccctccacctgtgtttgtacagttggcaagctgagaatggttttacatttttaaatggtaggaaataaatcaaaagaaaaatctcattttgtgacacgtaaaaattatgccgatgtcaaatttcagtgcccacaaataaagttttactggacaggacacagccatactcattcattcacaaatggcctgtggctggcggcttttacactgcaagggcaagattgactaagtgggactgagcctacccagatcaaaaagcctgaaatatttactctctggctctttacagaaaaagtttgccaaactctgatctaactcatggtacatttctggaaatgtggggtattaaaacatcttcatagtaacatgatcttcccccaccttgggttttttgtttgtttttggtttgctgtgccttttatttgttctttgtgacttacacttttgattaaattgtcacttccagcatgtccgtcttatgcaaagcaaaggggaagtgaatttggtgggaggtccgaattatctcactttgctctctagagcagtacctcccaacttttgccaggaagaacttcttttcatgcccccaaaatctgaactccctggagaaatcagagcccaagggagctttaaatgtgaagacacagagggtgagggatggtggcagtggagagaaaagtagatacctggtcatcttccccatatttctgaacaaccagtaaaaaaatgaagtaatgggaaatctccatccttggttgaggatccatggttttacgtggactattttatacaggtgctttaagtttatgctgataaatatttatgaatggtctagttccgttggggaaggaaagagaagacagcaatcacaggacttggtttctagagttttataaaattcagctactgtgaccatgtatacacacatcaaacaatttagaaaccaccagtgaagcacaaattaacataatatagtccaaacagaatccacagcagtgcttagggaacagactgggaagagactctcagtcaggcagagtctgccaaaatcgacttccaacaggaagtgagtttaagcctttgtgaaagaaaatgctccacagagagaggaagagagggaagggagaagtctccatgctggagcccatgtacgtgcagcaagtcatgtacaagaaatgaggggaagagagggactcagccagggggaggagttgccatctgtagcatttagatggaagaggtggaaggacaaacatcaacaggaagaagctacaggtttaactagagttgattaacactgtaaaataatatgaatgaatataaaataatagtgccagaaacacggtgagtcagcttaactgtgaagaagtttgggaatctctagccattaagtagaaatgagactttgatctctcgttatatcactaatgtatttttgaatacatttgaggctttggggatccttggggattcaggttacttattactttggctctagtcctgtatttcatggttatcttgtggccatttttatctctgtaaaaaaaatgagcattttcaaccccccatctgtcaataataatagtaacacccagcgcttgttttttttttagtctttactatgccctctgcttaatttcttttaatcctcgtaaaaatgttatgggatcagtcctattattgggactccatctttcagataaggaaaccaaggctggaagaaagcaatttatttaccttacttaaggttgcaaagcttgataatgttaaatctggaattcaaatctaggtctcactcattgcatctatgtctaccaggtttgcctgaggaaggaacaagcactagatgcttctttctaagctttaaaagggagataaagctttcgttacctccctggcataggactggcatagcagcttttcctgttactcatttcatattttcagtaataaactggcagctttcagatccatagctttatcatttcctgagagggagagaggtaggatggtctgatttcagggctgggttagaaccatgtaaaccctttggagaagaggtaaattaagtccttgaactacctcagccgtgcctttgttcagagaaaatagctgtgtatcatcaagtggagttaagtgatcatgaaaatattcaaaccaaagtggcatgtcattaagagcaattagaactgaagtgatgtgactggatattaaaaccagacaggcagtgctttgtgccttctcagtagagacaaggcagatgatttgggttcctcctaactttgtcatctctagaaataaaatctgctagacttcttagatgtattgatgccatgtaaatattgaaggtctgggatcatatactaagtttgacccctatatttccattatagagttttctcctcatatttcagtcacagatatgccagagttaattagatctctactagtaaatatccatcatgatgtttctaaatcccttttgccaaatgatctaattagagcaacacttggctttctatataattacaacatatggcacctagagggtacatatagtagaattataggttgcctgatgagaaatccaggtggtgggtaaaagactccattaaatagagtaggtgtgtgtgggtgtgtgtgggggggtatgggcatgggtgttaatgtacacaattcctcctacaattctccctagaataagtaatattttgtaattcagctgtccttcccacatgaaacaacatgattatatcatggaacaggagttaaaatttaaaagaaaacaaataattgatgacattaggataaattttttaaccttccatgcccctaaaaatgatcacatgtagtaagtcagcaaggctgaaagcagctctgtgtaagatgcattatgtgatgggatgtattcctccaagcaagatcacttacccaaactgctaaatataaaacaaagatgggaccataaagaaagaatggtttcttaatgcctatttgtaatctctggaagtagagtacccaacttcagtaggtgaagagttcagtgttggtttgttgaatttgaaaagcttatcctgcactgttgtgctggagcccagtagcaagggctcaaaagagtggattctgcacatccattcccagctctctgttcagcgatagctcacattcatagcttgatgttagccatcggcagaatatttacaccatggaaataggcccacttcaagggcagtttttccagagccactgtggtaaacattgacagcacaccactagctgtgggcatatgcagctcagagttggccacgccagtttaaagtccctgggacagatcaggtggagaaacatgactttccaaattgttacttttgaagtaataagggtgtgggaggttcattgagagaaaagagaaaagcaaaagggctgtggacagactcttctgatttatgcagagtgtgcatgaaagagaaaaagaaacagaaaaagttgtcagaaagctaaacggagaaccacgaaatagggctgctgtgaaattctaggtatcatgaatggacagtggtcaacaatgccaggtgtggccacaaagtcattcaggatgagaccacaaatgatatatatttggtgacaatgaattcacaagtgaccttgaaataaatactttagataagtgcaaaagctgtacaggctgcatggtaagcagccagatgcagtggatctttttgcaggtgttaggtaaggaatcggaagcttagatatactgcaagagagtgacatatttgtggcaaggatctcattaggatggaggagattggggaatatttatagcttgagggaaatcacactgtgtcgaagaaggagttaaagatgtaagggaggggagatgattctcaaggagagagcagaagaatggactagaaatcaattattgtgggaaatgatgaggaacctctgttctctgtgggtaggaagagaagatgagtaaagtctcagagaagttaagggtaaaaggagttgaggaatttcatataacatacctttgacctcaatctcaataatatgagagtcaaggtcatcttctgaaagtctggtcatgggggtgattgtgcacttgagcaaaagggaggcctggactgtgttttatggtcaatgtgatagaaataacatttgaattgagctttttatattttcagttgcttccacacacattgactttcccacatattgatttgctctaaagggttttattccaaaagaggtggtttgttccaaaggatgcataaaattgttatagaaaaaatgaggttgactgctcttaatatcaggaaagatgtttttcaggtgaatgcaatgtgttccaactcagaaggaaaacaatgcaatttaaaattactattatcctttctcattttctcaaggactttccctccttcaatcattcctgctctttctctacatcatcagactctcccttttcttactgttcctattggattgttccttccagcacatctgcatcttcctcatccactttgcctcctttgctctgtctactttccctctctctccaggcaatctcctcccctcccatggctgtaaacaccatgtgtgtactgacaaccctgaaatgtgtgtcttcagtacaggattctcccctgagcaatgtatggttaacattcttcagaaggaactcactcctgccaccagtctccaccctgaaccttagtcagttatacaccacctctctctgatcgcttgagcctgaaacctagaaatcactgctaatttctgtttcatcaccccatttatcctatgcatcaataaattttaaaaactttacttccaaagaacataatctatctccttctttctatgtgcattgctggtgcactggcccaaccaccctcatttcttgtccagatggttgcagtagccccgacgcgtcgctctgcttctatactcgctcccttccaatgtgttctctgtaccatagccagaatggtaatggaaatcaaatctcatcacaaatgcttaagatagaagctaagctgttgaacacaacctacaaggtatggcatggtctggctccttgctgtattatttttgtgttttgtttcatttcccctcccttacatctttaactccttcttcaactgcctctccctacctgtacgtgccagaggtctgaggccgtgtataccgcacttctcactataacaccagtgcctcctttcctcttcaatttcttctttgcatttttctgaatttgtaattccatatttatgttttcattgagttgactgttatctgccttcctaaactggcctgtaagctgtgtgaggacaggatctacctggttccgttcaccactatttatccagcactagccctggaatacaacttagggctttagtcaataagtgttcaataaatgaagaaagaaatcaatggacttacagcctcttttcacgaggactagagacttctccaaaaataaaagcaatagtaaagataaaagtaagtaatttagggagttggaataatggagaattgtcagtagaaaaataaaaatggcagcaataaaattagcacatagaaatactttcagtataattcacaggtctggttgtatctgtcttgctacccaatcaaagaaagaaacataattagttataattatcgtgtttataaaattaaaaacaattgtttgtccaatagtaaaatcttagcaaaaccttcctcatgagacgcaattactgcagttgatataagatttcatagatgtgccttataattttcatacatttggcaaatcatgtggtgatggaggacaccttagtaaattaacttctgtgaggtagggccaaatatagagctttttaatggtgaagcttgatgtaagggtacagttgtaaatactacatcaatatttcccaacacgagttcttgagatggggtgggaggtgatgtatagggtataaagtggtgttctataatcaaataagtataagaagtacaatttaaacattttgtattgcagactgtctcagaatccttaatatgttgattacagtgataatcttcaggaagcgtggttcccaaatttatctggaaatcaattttgctgcacagaatacatcaagggactagggtttcagggagcaaaaacttcggaaagctttcctctaagtggatgtaagactttatttactttaggaattccatgattaattttcacaaccatgattgtataaggacggattagaaggaaatgcaagattataattgctggcaaagaatagggagtgcacctattgtgtgtccccaatctagatgaggtgtatactatacagtagggcaaagagaaacgtgagggcaaatgtcagaatgccgcctttagggtggaacaaagatgcaagttccttgggagaatcagcaagcaggagaatcatttagctcacaactgattcctgtccacaaagtcaacaacaaagaaggctgggtaaaagctacagagagtctcaagtttttcctgatgtatttttccacaggctgttagacctaaaactgaatagctaaatcgaaagcaaaccagctatcccaatatagcataacagcatgaacaactcaagcctgcaattagcccagggagaacaggactttacttctagttccctcaagtgtggaagaagcaaagagagcacagtcaagtgagaaggaacactcggcaggttcttagcaattgcaccatcttcgttcttgatttaacatccagcgtttcatgttgattagtgaatacttggttatagagacacaaattttatttagattgtttgtttatttttagactcctaggtaatatataaatatataaatatatttatatatatatatatatattttttttttttgagacggagtcttgctctgtcatcaggctggagtgcagtggtgcaatctcggctcactgcaacctctgactccctggttcaagcaattcacctgccttagcctccccagtagctgggattacaggcatgcaccaccacacccagctaatttttgtatttatagtagagatggggtttcatcatgttggcgaggttggtctcgatctcctgacctcgtgatccacccgccatggctggtaatatttataatggccacaaacagttccctagcaattgatttggaagtgtttgcaatgctgggaacagatacccatatgatgcactttgcctacagatgtttgtatttgtatatgtgattatataataatggaattgtagttccatagtaaaaaataaaaataaaaatccattgatgaatttttcctcagtagctctaataacctttacctgtatcactcaaacataatcacaagccaaggtcatggttcagagaaaaaatgaatttttggggggttttttttttggtgttgctttgtttggtttggtttttgttccacaccctcaaataccaacagaaatataacacctcctttattaaattttatattaacagcaacattttgagataactagagcataaattttttttaccatttcattctcggaagcacaatagcacagagttaaaaaataaatctaagtagtagaattttaaagctaagagcagcatctagtctaagaactccttgaactggctcctcctccatgtgactgcattcattttctttctgataatcatgaaaagttgagctccatgatgttggtaacgaaacttttattatttctgctcctccatagaaccattttgtatttatttttgaatatgtcacacattttgctctccttgaatactagactctattaaacacctaccgaaaacacagcaaagcaaaatgtaagaaaactaacaggaataatttcaaatttcaaatgatagcctctgcctttatttaacaaatatttgaggcaactgaagtaaaaaataacatgaatgctctcttgaactttaccagaaccttgtctaaggctactgctactgccttagattgcgtgtcctgaaacaaactcagatgacaggttgcatacagaaggtttataggggagtgctctctgaggatacacctgcagggaagtgagaaaggcagaaatgagcagagagagaaactgtcctacaggttggttgcaactgggatttcagctagtcccactgagagctctggagctcagatagcccttcagaatggtcttaccttgaggcaagggaatgtggtctttaaatccctggatcagccagtcatgggcctcagatcatcacctataaggggtataagcttagtggaggcagttccccgtttcagggggtaattcagtaagcgacacagctttaagctgccccatattcttgggcagagtttttggaggtagaatgctttggcctgaaggagggaaatctgggtagagtactctttcctataattataagagatgactgtatggcacccttatcataggaagaaacatttggaactactcattatttttaaaaaaatgtcttatgttagccaattagtcttcaacaggatgcccggaggaatctgtctgaatttctcatcatgttcaaagcataagttgtaattgattctttcttggcaagggaacgcagtgtgattcctctgcctcatttcctttttccgatcctcccctcaaaaagcagactcagggaatatgacctagacagtatccccatttttagccttggggactctccattttatgaattccctttttccttttccacagacactctctcttaaaatgtctgggcacctccccctctcagcctttatcctctcttgcttactttttgtcaaagattgtcagtaacttcatttgaggaaggaaagaagggagggaggagacaggaaggaaaggaagaaagcaaatctgaagaaaataaaaaacttcgacatcagatcaataaaaccacctcttcgcctagttcctatgactttttatgcaagagggtcagtgtcttttctctgctttgagttgcaggaaagaaggacactttaattagcctaagttagtacatggccattgcctagaggatagatttgtgtcaaacctaaaaaatcaagggctagaaaaatagaacccattatatatacatcacaatatagttatgcattcaaattcatttggaatttttcaaaagtgagatagaagattttaatgtggaaatgttctgtacaacttatagatgcatgtcatattaggtaagagtagggtccagagagtctcatcttctttcaaggatgtatatcttttcctgtagctaatataatctctgattattaggatttcagggctaaatgaaactttagagataaacagatgagtgggtttcaactaccagttgaaaactctggttttcagccatccctgggggatgcagcatatcactattgttgaaaatggttcattgcacactgattgtcagaggaagtggggatggggaagaggtaaggggagaagggagggtcaataggagtgtatgagaatctcaggcaaggggatgctttggaaaatccctcctgaactttctgtcatgcgtggctttccaagccgtgggatttattggtttccccaggacttttgttttacatttatggtaaaactgaggttagatgattcatgacatgtctcataattaactattgacgtgtatatgctcatgtaacgtcatgtctcactgtaaagcaataaagctttctagcaagaagagtatttagaatcccaccagaaggttccaaaaatcatccaaccaagggttcactgaaatgagctttctttggcaagcacagtatattagctggctccacgtttaattttttaaaattaagttccaacatttataatttggtacatgccctataatccagacttcggacatctcttcaaaaactgaaggatctgcaacagacagcttgcttttttttttctttttttttttttttttgagacagagtctcactgtgtcacccaggctggaatgcagtggcgtgaacatggctcactgcaataatcccagacttctgggttcaaacaatcctcccttcttagcccccatgtagctgggaccacaagtgcacaccaccatgcccagctaatttcttaacgttttgtagcagtggggtctccctttgttgcccaggctggtctcaaactcccgggctcaagcaatcctcccaccttgtcctcccaaagtgctgggattacaggtatgagccactgcccctggccagcctgcatttctgtatggcaatacttatccagagctaagaagagttatccttttagcaaaaacatgaaatcttcagttagccatacaatccttgtatcccaaattaagatgtggtgtcagttgctgcttatcattgttttcgcattgtagtttttcttacagtaaaaataaaagcagaatattttttgcgtctgtttctctatcaaagagtgaaaataagaaaatgtagtcaaaaagaccacacacttcaagaaaatacaggaaaagaatatgttctcttatgccccataacaaattttcctgtgtacaggcaaagcatgtcatgaaaaccttcttgccagcttcattcatttttatgacctgcttacctcctataggcaatagtgcttgtacatctagatctagctctatccctttatgttaccaatgatcattcagaaggagaagaaggttttaaatccctcagactacctgtgaagtctggacaagaacctagttcctcacatctataatagtacagtgttctttttattttaccatgaatggttaatagtggaaactctgtgttttctcttccctggagattgtactaatctactcttgttattttttggttttttgtttttctttttgtcttcatttgctctgtcatactgacgtgaatggcaggttgtcaattaaccctcttcccagattgtattaaaatctgagtataaaagctacagccagatccctatctcttccattatagataccagacatctaacaacacccaagtgagggttttctttataatttttcctacacagctgattgtcagcctaacttagtgcctggtagataaaacggagaattaaacttgccttttaggccaggaaattattctgttctaacattattgctcatattaaaaccctgtgccattaaagctgtctctattaaatgaatatgtgctgggtgcgttgtttattcaatttaattgtagggaaaaaaaaaactcatacgagggaaatggttttttgaactggtttttaccagtcacaagccatgtgaatgagtgtccaattaaatagtggctcactaggacttgtgtaatagtaacatctgttaccttaattaaacaagttactatataaaggcactttcatagctcactttgttagagtaggttctgacctagaaactctaggaaggtttgttctctttgtgggattttgttggcggtagcgttcccagttggccccattaaactatagacctgacaagctctgtgatctacaaacctacaatacgttcaagcctacagagcctagaggaaggagggaactgaagtttgtgatgcaaagtggaacaaataaaatagtaaaagtgctgggtaggagtgcttcgtactcattttgatgaacttgggtgttgtgactgagaggcaagtggtggtggtaacagagaaaggagagtgaacaagtatttattgaccctccattgcatgttaggctcgcaggaaaatctgtatctgcaggcataggtctacaatcctgtatccatatctttgaaatccaaaaagctctgaaaacaaaaaaatatttttctgtcttttttcttctcttgttaatctatttgtttatttctggcaggtttggagcaaactcatttggtggcaaaaccaaactgaggctattgatagactttgtctttatttaccccatgttgaatcacagaaataataatatattgggttgtgagatactacatacaccagacttttcttgggatgttatataaaataaatatactatggtgttttttaatattcaaaatcctgaatgccaaaacacaactttccctgagagtttttgataaggggttatgtattagaccatttttaaaaaggtaaaataaactaaggctcagtgatattgttttgctcaaaaatagacaactaatcagcccttccagtgacttcccattcacttcaaatagtctctgcttgccatatcctgcagtgtcctacatagccaggcccctacttatctctctgaccatatctgctgctagctagctctttctcttagctacaatcacaccggctttgcagatcctcagtgacatctagctcttttttgcctcagggcctttacacttgcttttcccactaactgaaacactttcttccctgatctttaatgaacagctccttcttgtcccatatctcagctgaaatgttgtctttgcagagagacctcaagcacattcaaaaaagaccttgctcctgtcatgccaaccaaaacgagtgtgatggaaagttagctgaattcctactggattcatagatgaaataatatcagaaagaatacagatattatgaagtttgttttttctgcctaacgtctagtacttctttgtctgaaagaagcaccctagcgatgctttcaggaagggccttttcccattatttgcacccttccttgcttttttcagtgccaagtgctctgctgttctctacccagtggaccgggttatgggaaggcacaggctaagccaatcagaccctctccttctttcaagaatcagaattttcctatgggcaggacacagagcagagacattgggtggcagctccctggggatattgctccttaaattctactctctagacccccagagctactactggttgctgtcctttccaagccctatttgttctgctttttcttcagtttgtgagttaccccatatcttttcaataagttccccattttgcataatttaactttgcttttttgaaacagactttggtctattttagttacttacaatacccaaaccctaactgatataggcaaacagatagaacatctttaatttgtatgtttttctctaaatctaacttagaaaagtaactctttaatggcatttgggtgttcatcttagtggttaaaaataattatatcttatcccatttgaataaaacaacttaagaagttgaatatctacaatttgaggaaggggagcaatttgaaacattttgcttcgcaaagatgtttgcatccagcttaactgcttacccacctgattaagtaccttatccatgactaatggagttgtcgaacatgtggacttgcagagactcatggaattaaaatggatgtatcccctccagagagccctgtttcctcgaagggtagctagcactggagtgggatgctgtgtattcccacaggcatgtgctgacatgggagttgctgaaatttggaggctgaaacattttggctgcctttgtgcaaactcaggttgtctggcatctgcatcctcccagaatgagtcattgtatgtccatgcttcattgattcttgctgaaggagatttggacaatgggcctgaacctgccaaatgagtttgggaagccccaaacacatcggtagcttgttatataagcatcttgtgctcagcagttaggcctgccactgtctgtgatgagtagcaggtccctgtcatagtgacatccagatgaggttatttgcttacctctgtgcatgacatgtgagcccaaagatgctggactaggtcctcttccagcaaaatggtgcgcattgcccagatggtcttgcataagctgagaaagaatagagaaggcaacgtgtggccactcacctagactctcatttgagctcccttgtcagtgctttatgaatgtggaggatgaaaagatatcccagcattctttgatgaattggttttaactctatatggagaccttcctgaatcccaagataatctaatctctatttccacagcccatgaacttatccttataacatctgaagttcaaattatttatttagaatttgtgtcctatactagaccttacatttcatgacaacacgagttgcctatcttgatcattgtcatatcttatgcacttagcatagtacttgacacataatggacattaaatacatatatgatgaatgaattcactagctgtatcactttgggcaggttacttaatctctcgaaacctaattccccatctgttcaatggtgataataatggtaaccatcttagaaagggttatatgaggtaacccacgagaagcttagaattgtgtcttttgttgttatcattgataataaataacgaacaatgaatcttccctctactttcaaaaagggaagtcatatagaccagtggtcccctttttggcaccaggaactggtttcgtggaagacaatttttccacagatggcgggtggggtgggaggtggttttgggataaaagtgttccatctcagattatcaggcattagattctcataaggggcatgcaacctctagatccctcaaatgcacagttcacaatagggttcaggtcctgtcctgtgagaatctaatgctgctgctcatctgacagaaggcggagcacagactgtgatgcttgctcacaggctctcacctcctgctgtgccacctggttcctaacaggccatggaccagtaccagtctgtctgcagcctgggggttggggacccctgttctagactactgtgtaaatttagttcgtgcataattcgtctaaacttattggtaatacatagatatttactgtcttctccatgactccaagaagtgttttaactttacagatgaaaaggtcctacaaggaaggtttcagtcgttcatatgtgtatatcagaaaaacaaaggtggctcatctctccacagtagtttcactggtgatattttcattgcaaattcctttttacaggtgtcaaaaatcatagtatgtgggaatgtctgcctctagtgaccttcaatgcactattaaaaaaagaagttttgttttggattgccaggattttaaccttcaaactagcctgtgtgtcatggatccctgcactagaaggcttttagaaaaacagataaactaaaaggaagctttacagactgaacatcagctacaggaagacctaggtgattcccaactctatacccaggtgccaggaaggttctaaaagtcagtaaacacagagaggccattctactacccctggcctgaggccccaaattctggtgaaaagttctgctgcccttgtagtatggagctttttaaagcaaaggcagaaatacttagaaaaagaaagaggatgagcataagatctaccttctcccaaagcagccttatcgaaagccttagtgagatggtttctaggatatagttggaacctgtctggactcacagctccctatgtatgttgaactcttagtccaagactctcttggatcttgaggtaactacagtaccataaaaaggactagatttggggaatggcatcagagccagagctttgccatctatgtagtcttgagcaagtcacttaatttattgtacttaaaatggacttaataagaaacacctgcaatgttctgctcagatttcattagatgggaaagtgctttttatatggctctaacctctaaccactgtagagtttttgttacatgcatttttaggtctatgtgcattttttcaaaatgaaattatataataccttattgttttattatttgactctttgattgacagtatatagtagataccattccctactgaagaatataacattttcattctatgtttttattttttatggcgcaatcatatggcattgtatgactttgtcaattcactacaaatatttattacttaattttgaacagttcagtttcttctttagaactgctgtttaatctactacagttcacatcaattgcatcaaatctctagtattctaattagaatgcaataccaactatgggaattaccaagcagctgtattttgggcatcttcaccaacatggttatagcaacagcgaggatttgttgagtgagtgcctaatatgtgctaggtattttacatatactgtaccttgtataaatctcccccaaactctccagctcattgtcattctgctcattttgcacttgaaggaactaaagctcatcaacatcaactaacttaatcgtagacatagagatgactaagtgacaaaactggaattcatctgtaggttatttgacttcaaaacgacataaactgtgtccactatatgaagcatcttgcttgatctcaaactcagcacatttggatttgatctcaatgtcttgcccttgtctcaaacatgtctccaccgtgtgccaccattttatgaatggtgccatcatctaccaagctcccctaactggtagcctttccttccaactgccctgagatgacctttgtgaatgttaattccccccagattgttaattctaatgaccagcttccattcttcaatttctcagcaccatttgacacaggcggtagatcgctcctccctctgaaatccttgtttcacttggcatccaggaccgcataggcccctggttttttttttttctagtccatccaggccacttcttctccatttgtctattgggtcctcctccattctacaacttctaaactgacccggggcacagtttttgggccttttttgtatatgtcccttcttccttggtgtcttcctctagtctatagccttccaacttacctaaacactggagaagtcatttatatttccagcctgaaattctcccagaatttgagtatattgaatgatatattcaacacctacctaggtctttgcaatctatcctaggcaaaaatgtcctgactccaacatataaattgtcttcccccttagtgaaaggagaggaaagcagtgaagctttgctgggcctattgatttggatgacacgtgttctctgaatcacctagagggattcattgattaattgagtcattaatgcaccgattcattcattcaaatattatttagtgactacatcatttgccaagtaccatgctaagaatctagataaaatgtttagggccaattatctaggaaataagttttctaaattaagtcaattcttaggaatcaccttttggttttcatactaaacagggaatggagtatttctgaatcattaattcccaaatcaacttttctaaaatatgcataatcgtttccaaaatggagatttatttagatgtcacacaagataattgcagctttgtaaacctaacctaagggaaattgagttttcattcagaaaccttatcttgattgcctagacatcacccagcatcctctgacgcctctgcttgatgtccttatgtcagcctgtcctcaggagagaaagaggaaacttcaccaaaatgaacaaggtctttcaccttctccctttaggttttaggaagaagctgtttatgaaagttgtcctccagtgcccattgggaacttgcaaaagatcagttactaccgatggacagtatgtctggtctttctctctttttccacatattaaattgtcattgtgtcaaatgtcttgccatcaaatacggtgctgcaaagaaattgcaattatatttatcagttttttttctctgacctttgaatttcattcagtccacagagaatccttctcggtggttcagagaacatgtgtcatccaaatcaatagagccaacaatctctgatttttctctccccctttcactgagggggagggcagttcatatattgaagtcagaaccttttaagcctggaatggatagcaaagacctacagctttagtgcatgtaatcttgcaatgcaataacctggtagtcacgcaatctggacctagtaacaggttaccacaattccatatggagttttctagtgttttcatcctgtctgcctagtattaattttgagtttctgtctctggaaaattttgtttagattttaaaatcttggtttttgttctctaatcattttctctcactataagattctgactgtcagaattaaatatgttataaaactaatgtttaaccgtagtctcattccctacgccctgccccctgccccgcaccaccccaatcacctagaatattttgaaggaagaaatgggtggtggataatagcagccaggttatctggcagcgcaacctcattttaatattagctaaagcagaaatagtcaagagggcaagtctgccatgaaaagtcttatgaaacattacaaagttaaatggaccactaaaaaacggtagacagaagagacagccaggtgctcaccaaaatcttacagttgaactttaaaagtcatatataatgagcaagattagatgcaaaatcagccataaaaataaactatttcccaagactcaaggctaaagtgcacctaaatcttatttattagcatgactgaactagcagcacagtaaatcgtaattgcatgtgtcagtcacgtggtgtttattaggccttttctgattttgagtgacaaaatacacacaaactcatctcttctatccaccatgttgactctgttctcagacaggtgtcatcctcattaccacaaaatggctgcagcagctctagacattaaatattcagatattcaattccagaaggacagagtgagaatcattttccagaaagtcccaggaaaagtctcattgtagcttactgactctgattgagtcgtataattatccctaactaatcactatagccagaagacatgaaatgctgggattaatttaagcctgggccctgtgcttcatgccaacatttagtagtggagcctactaatatctcatggcagaggctgaaagagggataggtttttaagtggctattattggatatagtgctaatggacgctggacacaactgtttgaacaagaaggaatggtcaaaagtgacagatattgtgaagaaattggaacccttttgcacagctagtggggatgtaaaatgattcagcatcaacatcatgacatgtcctcaaaaaaattaaaagtagaattaccatatgattgaacaattccacttgtagagattactccagaattaaaagcaaggactcagctagatatttgtacatccatgttcattgcagcattatgcataataatcaaaaagtggaaacagcccaaatgtctattgatagaagaataaataaacaaactggggtatacagtggaatattttccagccttaactaggaatgaaattctaacacatgctgccatatggatgaaccttgaaaacatcatgttaaatgaaataaactggacacaaaaggacaaatattgcataattgcacttatatgaagtacctagaataggcaaatggatagagacagaaagtaggataatggttacaaggtgatgggaagggggtaatgggaagtcattgtttagatgggtaaagagtttgctagagatgatgaaaaagttctgaagatggatggtggtgacagttgcacaacagtgtgactgtacttaatgccactgaattcaacacttaaaaataattaaaatggcattttttatgttatatatatattttaccacagtaaaaaagatataaaaaatggaaaataggcaaagacaaaaatcaaaggggcaatatatactcccatctaagttaataaatgatgggaatgttacttcttttttatttttaataggtaaatgatgctaattttatttcttatttttaattatttaattgataaaaattaaatattcaaggtgtacaacatgacttgtgtatatattatataatgattaccacaatcaaattaattaatgcatccatcaccagattgtacattagacccccggaattgttcatcttataactgcaattttatactctttaaccaacatcttcctatttatttcccctacctccagagcccctagcaaccatggctctactttctgcttctacgagctctacttttttagatttcacatgtaagtgacattatacactatttgtctttctgtgcctggtttatttcacttagcataacatcctccaggttcatccttgttgctgcaatggcaggatttctttctttttaaggctgagtaatagtccgctgtacatatttactagtttctttatccattaatcccgtgatggacacttgggttgtttctatatcttggctattgtgaataatgctctgatgaatatgggagtgcagatagctcttcaacatactaatttcattttctttggatatatacgcagaagtgggattgctggattatatggtagttctaatttaaatttttttttgaacaaccgtactattttccacaatggttataccaatttacattcctatcagcagtgtacaagtgttgccttttttccacaccctagtcaatgcttgttgtctcttgtctttttcatagtagtcattcttagcggtgtgagaagatatcttattgtggttttggtttgcatttctctgatgattagtgatactgagcaccttttcatatgcctttggccatttacatgtcttctttttttatttcaactttattttggattcagagagtacatgttcaggtttgtaacatgggtatattgtgtgatggtgaggcttggactacagatgaccccgtcacgcatgtagtgagcatagcacctaataggtagtttttcagctcacatcccctccccaccttccccactctaacagttcccagcatctgtttttctcattctatgtccatgtgtactcaatgtttagctcccactaataagaacatgtggtgttttgttttctatttctgtgttagtttgcttaggataatggtctcccactgcctctatattgtgacaaaggacacgattttgttcttttatatgccgcatagtattccatggtgtatatgtgttgcattttctctatccagtacaccatcagtgggcactcaggttgattccatgtctttgctattgtaaatagtgctgcgatgaacgtaaagtgcatatgtctttttggtagaaccatttatttttctttgggtatatattcagtaatgggattcctgggttgactggtagttctaagagccactgtgactggccttttgatgatattttgatttgtctaatggatttctaatttagtatttctctgatgggaggctgttgcattttaaatggatgtttccacatattgcaagactgtagcatctctaggcccaggcattcctagtcattctgacaaacagaaaatctccatgcttcccaaacgtgctgtaagaagcattgttgcctccaattaagaaacactggtttatgaggaaagaaagtgccagttaaactggctgaatggcagttttatttcatatggtacattaataagtgagcaccccattttatatactagtttctcattagttcttatatattttaagtaatcaaaatgacccaggcaaggtaagttctgaaccttcagggtgaggcctagatattggaccatggaaattcactggcataactcagtttattgaattctcatggcagcccaaccagcaccttgcctgctacctttgtaatgtgcttcttctaaatgttagcataaacaatctgcatttttttgaattatcccggtgattgcttccctggtgcaactatgattaaaaataagacagataagttctaccccaagtagcttacaaaatgtaagcattataatacaatacagaaagcaagaatccccttaagtagcagtaaaatcacaggctgcaagaatgcagggcaggcagaaagacttccagctgcaggaagcagagacagcttcataaaagaggcaacacttaagaggttcttacgtaataagtaagcagtacatttgtagaaaggttggagaggggtattctgggtatgctatgagtaatccagggaactaatgctcaacctaggaagtctagattttatgaacttatggatccctttataactccagagcaactgacagaaagatggaatagcattccattggctagttgtcttgcccaaataacttgtttgacaaaaaccgtgcctccagggaacagaagggtcagtagtcatttgagtatctgcatatatacaaagacacatatacaatgagaacaactgaggcagaaattgaaagcaaagctctcagtgtctatgtcagagcctttccccagacggtgctaagtaaaatatgtaagcacttaaggttagctataaactattcctttgggcaaggaaataaatattattacaggaaactacagcaattttttgacatcaggaaaagaatatagtcctgcaaagtccttttaggtcaaggaaattagcttctaggggaaaatatatttaaaaacaaagagtcagataatgttttcagagcaagttttcagaaggcagtctatttccagtttatgctatctatagagcgtctgtgtaaagctctttaaaaatgtaaacacctaattgcatttcagtatgataagaccataaagtctttaagtctccacaggtatttatgagttcttggtcataactttgaaagcccttttcataattatgcctatcaacatattgtgaaaaaaaatcattgaggagcttacccttggctttagaaatagtatataccatctaattattattttaatataaattatttccttaccattagattaatatctagcccagagcacatgtaattgagaaatctgtttttttatttttagaatcatactaaatttttaagtgactgatttttcaaaaaaaaaaatcttctactcatcagaaacagtttgggatctgtaaaaatcccctagtttattccagacgtaaatttccccaaagacttttagcacctattaagtttttgtctccctaggtatgagagtttgctgtcagttaagaggaaatttataagaaaatgttaaaaccagcttaaataactttctagttctatttaatgttggtacaacttcaatgaaaacatttcaagtcagcatttcaaattcagctgccaagactcaggtaatatttcctggactcaatcatatgggcatgaaacactgcagttctatcttcaaagtcctttgaaatctgtctcatgatatctttagaagaaaatattccaaaatgaaatgaagaacttcattttcagctgaattttcttaacgtctgtcaccttcttaggtgtgggttctgaattttaaatattcctctttttgaacctgtggagattgtaaaaggctacatccctagtgaaaattggtttgagataattccctggaaaacttttgtcaaggtgtacagttgtcactttggttcatgttagaaccaggagaatgtaatatgtaataatgactaatgcccctttaaaagagcatttctctcttttcttgtctgcagatatttctcatgtctataggtaccgcacgggcaagagccatactttagataaatacaggttttgagtttttttgttttttgttttttgtttttggttaatatactgtctctctcaaaatcaaaaataaaagctaaacacttgaggctgcttataatacaagttatatataataggcctgttaaaataaaacatttagacctgtagaagaaggggaatgtgtactttaataatgacttagttagtattattagtgttttgagtttcctaggattctgagccaaaagagaaatcggcaagctgttaaataaagttcattatatgaaaaacggtgttgaagagagacaactttctcctgactttaaattatacattaaatgtgttagttgaatccaggggcaggttgattgcagtaatggcccctgctttgcacatgtcctgcgtcatgtcctttggtagtgccttcccactttcactcttgacttggccagactgcttgctttggccaatgaaatggtagtagaatggatgcaagcaaatgattttgaaagtccttgcacattggagcctaccccttgcggcttttcaaatcgtttcgctaccatgcgaacaagataaaggcctattgtgccgggcgcggtgactcacgcctgtaatcccagcactttgggaggccgaggcgggtggatcacgaggtcaggagatcgagaccatcctggctaacacggtgaaaccccgtctctactaaaaatacaaaaaattagccgggcgtggtgatgggcgcctgtagtcccagctactcgggaggctgaggcaggagaatggcgtgaacccgggaggcggagcttgcagtgagccgagattggaccactgcactccagcctgggcgacagaacgagactccatctcacaaaaaaaaaaaaaaaaaaaggcctactgaatattgaatgaagaggagacaatggcctagtccccctcatcaccccagccaacacctagctgaaacatagactcaagagcaatgaaaagtcttgttattttaagcaactgagtttgggggttgtatgttatgtggtgatagctaactgatacagatatttagacaagggatatctgctaatataatggacagtgtcttgtacagtagtttttcagcaactgttgaaaaactataggactgtctccttatagcaaatgacaacccttgagagcataccttacataaaaataaagatatttttattttcctcactgcctgttatatcaaatgttgttaaatccctgctagagacaacatacccacctctgaaccagaccaccttgttattagaagagagccatcctttgaagtcacacacaacaacactgcttaatggctagggaaacaaaggctattattaatctaaaatgctttaaacagggcttagagagaatgaaataagcagactggagtttagccatggtgcaatgctttgagggcgaaaacaaagccatccatttagataagctttgaaaaacactgtgtagaggggaattcttctagaaagtgtgtcttaacttctacaatccatttgatactcaaaatttttgtgttcctgctttcagtggcacttcctataaaaatccattgccttttccttcttcatcaaagtctttttaagcttggggaaaatagacttgtcaaaaacatgtcaaagacaattacatttgaaattttaagtcatatgaaagatgtaatttgaaccccaagacttatagactctctggacctcaaaaattatttaggtcaaccctatatgatttttgaattccctccaggaaaaacctaacttatctggatctcttctgccaaagacactcccagtaatagaaacttctgtggagaattatgccccttagggaatttttatgtaataaaatgtttatccctagatagagccattcacttttaagccagacgcctggtgcagcacaggaaatcccaggtttcctttctgccacactcttccgaatattcaaagacagcagctcttctgtccccaggttcaccaaagtcatttctttgttcaccaggctaaatgtgtcagcattcttgggttgcagttaaccaaaataactctagctaactcaagcaaacaggaattttattggaaggatatgagggacttagaaaacccctggaagaagcagttttgaaactaaatgaatctaaggtgtccctctgggattaggaaacaggaaaggcagaagctgtatatttacaggaatagtttgatcagggtgcccctgctgagttcatcaggttctttgtcctgctgttccaggaggaaggagttatgtatgactattgtagctttggttgtaagacacagggaaagggagggcctctgaccacagccttaccagattgaatccagtgagaacagctatcctcaaaagaacatatgagtactatgaaaacgggaaaatggatactgagtaggcgaaaacaacaacaattaaaataatgttgaacaccattctttcatcttcatgtgaagtggctttgagtcccatccgtcttgttcctgtgaatcatccagtgtccttagctgccctcttagttggtgttaattttttcaatgaccctctcaaatggtggtgccttgtagctctagctgcagtttgatcagcgcagagtagaatggggttatcccctcccgcattctggatgccgtatatctattaatgctgcccaggattatgttcatgtttttggcactctcatctgcccatcgagtcagactgagtttaaagtcacctaaaacctagtaattaattttctcaccgtttctctagtctatgccacatctgcccccatcattatcatatctcttcctgtgcctagaatgcactcttctactttctgttattgcctagttaacacttccttttccttcagacctcgctcgtattacctcttactgagactcaatttcccttttatagatatttataatactatacacttttcctttacagtacctcatatgatataatttcacatttatgaatgtgattatttggcgtcaagatggtctagaaagaaaatctaaatttcttattacatgatctagcccaaaccttagcagccaatctcatttcttaccactccactcacccatcccactggcctttctgttccaggaaaacacaaatcctgctgtttccttagggcctttgcacttgatgttctctctcattccccattctttgtctgaccactacttatcatcgattagatcttagctcaagtaatacaaagagaggccttccatgtttaacctaaagaaattccatcatcttttgtgcccccaacacacaccaaaagtccatttctatcataagactgtccatattttcttcttagcacatattactgcactaacttatcacattcatatttgctttatttgctttattgttagtctctccttccactgaaatgtgagatccttaagagtaatggcattatttgtcttatttattgttggatacctaattcccagaagagtgcagggcccacagtggatgctcaggaagtatttgttgaattagtgaattgaagaatggtcataaacagaataaattgtcttttccaatagagtttaagtttcatgaagggagcaaccgtatcagttttgttcactattgcatctttagtacattgcctgacacatagtaggttcttattacaaatatgtttcatgaatgcaataccatatttgcactattagtgtttttgagcattcatagggacatttatatttcagggatatttatgttcagacctgactgatacacaatatgtgagcttttcctctcaattccctatcatgaggaaaagaaattggcatcttatctctacctccacccaaagtaatcggcaatttcattggagaaatttttagccaccactgagactagttctgcataagaaaattagactgagatctagcaatttactagggccatcagtttaattatgaatatccaatgtgagtaaatcagacttcaaatgatacatgtttttcaccaaattgcttagtaactctgtcaactcttccattcattgatctctaaaattggaagacttgaggtgaaattccagtctcctaatgtgtagttcagtgtttctctgactttgggagcatataaatcacctaagaaccttaataaaatgcagaatctgattcagaaagtttgggatggggcctgagattgtgtgtttcttataagctcccatatgtgacatagctgctgacctcaaaccaaactttaagtaaggaactagataaccctggataataatagcaaacaccagttgtaagcaagtgtagcactttgtagttttcaaagaacttatttgtaaattaatttttaaaaatccctacaaagacacaattattcaggtatagatgaggaaactgaagttgagaaaactgacacctttaattgaagtcgcacaactagaaatttaaccaagtttctccttccacaactgcagttgtttccccttcacatcatctgtctggaccacattcacccactcattcacagtaaatttaattatgcttccatcgtgccctactcgaggggttgaagatacagcagtgaatgagaaaaagatcttaccaggttttctgatgtgtaaatggaatgattggcccttcccaactccagtggtctgtgattctattacggtgtgccatgtttaaaaaatgaaattatagaattaaggcattatcttaggtatcattttctacctctgtgctctcagaatcaataaacttaaattcagctgatcatcaccgtcatacaaaacttcctcccacattctttgtctcattgcagacaagcatatcggagccaaatttcacgctatccaatcaataattaattctcctcctaactgttcctcctaaattgtattgttttgtgctcctcctggccactgctgccctagttcaggttttctcttgtctagtctggcagtgtctagaagcactttctctggtgatggaaatattctatgtctgtgctaatgcaatacagtagccacttgccgtatgtgggtattgagcacttgaaaggtgaccaacgcaactgaggaagagaaattttaattttccttaattttaacgttaagtttaagtagccacatttgcttagccatctcttggacagcatgtgcctggatccttgcaggaacttttctgcctggtttccgctggcttcttcttatatctaaattgattttcctcattcattcaccagcatgatctttccaaaatgtaaatctgatgatatcactcccatgccttaagttcttatcctgggataaagtctttgcttcctatgtgactggcaagggtctttgtgacctgacccctttctgaacccaccagccccgctttctgcctcacagttaatgctctgacaatgagctaccaccttttctgcatgtcgtcccctgtatgtatctaactcctacatatcccttaagaatcagttcatctccatgaaaaattatcattgattcatccccacccaggacctctactatgttttcaggatactctatagatacatatatcatttcagggaaccacattattttatctgtctcatatttattggtggtgatagtggaaattcaccagactgtgaatttcctaaagggaagggttatttccaattcatctttattgactgagacactaccataggtagtgagcactactagccattgaatgaatgggagatgaaaagaaggagagatggaagaaaggaaagggggattaaaccagctagtatcaaattttaaaaataaatattggctgttaactgttcgggaatctcaatttttcagttaactttatttttttttacagttgatagctagtataaatctcagttagacatatttggatttttggaggactagtggataggtttcctataaacaattgatcatttgaatttagtttcagttgtacaaaataaaaggcattcaggcactgaaagacaaattttgcacgttctcacccacatgtagaagctaaaaattaaaacaattgaactcgtggagacagaaagtagaataacaattaccagaaggagggaggggtggaaaaggggtgatagttaatggatacgaaaatgtagttagacaggatgaagaaaatctatcattcaataacacaatggggtgactataatcaacaataatttattgtatattttgaaataactaaaagcacaaaatttgaatgttcctaatacaaagaaatgataaatgaggttatggataccccacttaccctgatgggatcattacacattatatgcctgtatcaaaatgtcacatgtatcccataaatatatatgcctattatgtacccatagtaattaaatatacatttttaatgaagaaagaataaataaaaggcattgtatcttctctacatagacagattattttaatcagccaaattatatttccttttgctaaaatgtctgagctttgactatattgactggtggacttttaaagccagaagacactaagttcagccatattgtaactgctcaatgggttcaccctgcctgctgcctagacagagcagatttatcaagacaggggaattgcaatagagaaagtataattcactcagagctggctatgtaggagacaggagttttactattactcaaatcattctccctgagcattgggggatcagagtttttaaggataatttggtgggttggtggggagcagggggcagtgagtcaggagttctgattggttgagttggagatgaacacataggaagtcgtagctgtcttcttgcactgagtcagttcctgggtgggggctgtaaaatcagatgagccagtttattgatctgggtggacccagctgatccactgagtacagggtgtgcaaaatatctcaagcactggtcttagattttacaatagtgatattatccccaagagcagtttggggagggaagaatcttgtagcctctggcctcacgactcctaaaccataatttctaatcttttggctaatttgttagcctacaaattagctggggtctaatccccaggcaagaatggggtttcttatgggaaagggctgttattgtctttgttttaaactataaactataaactgagttcctcccaaacttagtttccatcccaatgcccaggagtgaacaaggacagcttggaggttagaagcaagatggagctgtttaggtcagatcgcttttcactgtctcagttataattttgcaatggcagtttccatatcatttttcagaggaaaaaactatacaacttacccatgattaatcagtaagttagtggtgaattcagtagaaactggtgtgtatatgaacacattcttgaagtctaaatctggaaagaaaggcattttgtttttcaaatacctacttcagaggagttttgtttgcttttttttttttttttaatgacaatgattttggttgagattttacttaaaacaaaagttacaaagttgtgccgcctttggtacttcatgctgtgccagttaacagtggggtgggtcatctgtctatgaaccatgaccattttcagttgaaagttagggaagtctgccttatctcaaaagcccttgccttcaggcttctgttcagatggtatcagctggaacaaataagctgagattgcatttgctgttttttgtgctaatctcaagaacattccaaaaatggtttgtcagcagctgaactgagcacagaatctgtgggcatgaccatatttctcctcacaagaaaaatcactttttaagtttcttggaagttgattacaatgtgctttttgctccctcttcaaaagtaagataagtatcggaatctgtcattttctgctttggatgtatgcctaaacagccaaagaagcgcatcaaaaccaaggaaaaaaatgtggaaaggccaacctaaatgtatatagggtatagtccatccacagactatagctacacagacaaagtgaggtgaagaacttggcagttatctgagggattttcccagtttggttgatgcactcgaccatccagagttcctcttgttaagtaactttttgtctgaattttctgaaaaacagaaatagcactaaagatgaatcctgaactctgaataattgtattgtaagtcagaaaaaactttttgtgatcagccactaaaagggaagtcacaagaagagtccaccactactaccaccaccaccaccaccagagcaaacttgtttacagcctctctgagtcattactgtgctaggttttgaacacagagagcaaaaggactatattgcatgagcttatagactggtgaggagacaaacaaggaggtggacagttataatcaggatgggcacccatgttgacccccttcttctggtgtttcagccatttgatgcatcatctatggacacacagatgtttcctctgtatacactgtctcacaagtgacactgtgtattcatcaccactcttcaggttgcaaatgactgaaatccaacccaaactggcttatgaggcatttttgacaactttattgaagtataatttacattccataaaattcactcattttaagtgtacaacgcaatgatttttagtaaattgtactaagttttgcaactatcaccatcatctcattctacattattttcataatatttcaaagggaatctgctgactcacgtatctgaaaatttcagggtttgctgtatgtgctaagggaatatcatcaagacttcatttttgttggtttcattcttagccaatctattccctggtgaaacgacaaatgacccctagcggattatctaccaccttagtaaccccagcagaaaacatatacctcttttccagttgttggaacaaatgtcttaggatgacacacatttatcctgattggtctaggctaggtcaggtgtccactcctgaaccaatcgctttaaccaggagtgtgtgatgctctatctttggccatgtctgtgtcacatgaacaccccagcagccagagaatggtgttacagccacccaaagtacatggtctgaaagtggggagacatgatttcccaaaggaaaattgggattattattattattattattattcctagacaaagagaaatggatgctgtgcaggcaatacagtagatgtccaatccacaggaaaattgtgatcagagtgacgttgcttcttcccttttgaatcccctgtagtggttatcacacagccttttatatagcaagtactcaaaaaatatctgtggattggtcatggacaggctaaaacatagaacagaccaacaatgacagacttttactttcttattttattgttggggaaggctaaaaaattaggagtatgatttcaattattaaagctaataaactggggcttatctgagaggccacatgggagcatgatggtcagagagcggctggatgtgtgtcagaactcaaaagcagattgcagtcagactcttcccctgtgtaggcattgagtacgtagatatatacacccacacacacagacagttgacccttgaacaactaaggggttaggagtaccaaccctctgcacagaaagaaattcacatataacttttgactccccaaaaccttaactatcaatagcatactgtttttgttgttgttgttgtttgttgttgttgttttaagagagacagtcttgctctgtcgcccaggctggagtgcagcagcagcataatcgtagctcattttaacctctaactcctgggctcaagcaatcctctagcctcaccttcccaagtaattgggactacaagtgcatgcccccacacccggccgattctttcatattttttgtagaaacagggcctagctatgttgcccaagctagtctcaaactcctaggatcgagtgatcttactgcctcagcttcccaaagcactaggattataggcatgagccactgcacgtggactaataggctactattgactagaatgccttaatgataacacagtttataaacacttttttttttaattgagacagttttactctgttgcccatgctagagtggtgcagtggcttgattccagctcactgcagcctcgacctgctgggctcaagcaatcctgccacctcagcctcccgggtggttgggactacaggcgcacatcactacacctggctaatttttgtattttttgcatagatggggtttcacaatgtgcccaggctggtctcaaacacctgggctcaactaatccacccacctcagtctctcaaagtgctgcgattgcaagcatgaaccaccatgcccagccaattaacacatattttgtatgttatatggatcatgtactgtattctttattattttttttgagaccgattctcactctgttgcccaggctggagtgcagtggcgtgatcccagctcactgcaacctccgcctcctgggttcaagtgattctcctgactcagccccccgagtagctgagattacaggtgcccgccaccatgcccagttaattttgcatttttcataaagacagggtttcaccatgttagccaggctggtctcaaactcctgacctcaggtgatctgcccatctcggcctcccaaagtgctgggattacaggcctgagccagcacacccagcctacgctgtattcttacaataaagaaaataaaatgttattaagaaaattataaggaagagaagaatatattgactgtttattaagtggaagtgcatcatcatacaggtccttatcctcatcctcttcaagttgagtaggctgaggtggaagaaaatgtgtgtattagtggacttgcacagttcagacccgtgtatttcaatcccgtgttgttcaagggtcaactgtatatctatctatctatatctatatctgtctgtctgtctgtctatctatctatctatctatatatatatatatttggcctttcttattgctctttcatcagaagagtaatgctagtgaatgatctggaattcagtggtataccataagctggcaagaaacctggcaaattgtaatttatattcacaaaacatttttttcaaactatgcaaatctttacatctaacagaaaaacaataagcagaattctagaacctttggaataaataattcagtaccaatagatacattaaagtatattgtttatagaaaggatcagagttgaaaattgttaaggaacaacctgtattttaaaagtaaattttataccatttttcctaaaaggaatatggttcacagcaaatttcagatccataaaaactttatcttctagtgacttttaagattctctttcttgacaggaacttcaagaatggcaagatatttctttcttccacttaactgcaatgtgactatgaagatgctgtaaacatttgcaaattaggttgtaaatagcagcaatgaaagcattaactctcatagccacattttcggaagtgcactttacattatgtggagataggtattaagaaataaacctgaatgcttatataaaaattatgctggagataggtattcagaaataaacctgaatgcttatataaaaatccagcctcctattttccaagcacagtggtataattacagctctaatttatggcatactttgtaggattgctgattaattatacagacctcctgatgttttatattcttttcaactttgtttccctctgctatgtgaccactacaaagcgagtatccctaaatcacttattattcaggttacctaatttttaaaaagtgaatttgctattaacatcattttcttatatagcactgtaacatttatatgttaaaaattattgtactccttaatgttgcagctaactcatacacacacagacacatacactcactcctacacatacacatacagacacacacactcaaagattttaataaattcccgatatttacccaatgtagacatgtctaacagttctgcatgacttgatctgaaatattgaacacttcaacagtgcaacaaagcatgattcgttagggataatactaaccaatctcatttttaaactgattatagggatccaatttgaataatttgctgctgtggattatttggaaacagttgtagcacattttgtttgttgctcgaggttatcagtgttttcagaacactatcttcctttcatagttcttttgagtttaatagttatacaaaagccccatttaccagatttttcaataaatgtagtgtgctgatgattacaggaggatttgccagaaaactcctttacatatacatagtgcaatatcttcagatattatcctcttctttgctttaagtaggtcaggttcacaatgagctgttctccttaaacccctccccttcatatccttatcaaattccctttatcactgtcacatctaaattactatcttctgctttgccaccaagacatttttaatagtaagagcttcctgctcctttcttaagctcttctctttttcggtcatcaacttccccttggaattaggaaaaggcccttgtagatttgggctattaaataggagaggacccatgtatcaagtccttaaatgttctgtcatcatgagaattatttattggaacccattacctgtgcgacttcacagttctttttagatggtttgtctgaaaagaataaaggctcttcgttgaaatgaaatcgctttctttgctacctagggaagaaaatagttgagtctaattatttagaaacgagaggaggattgctgtaaggacttgagtcgatcatggaagtttctcctatgcaaaacagatctgaaggtacagaaaacataaaaataatatccctgggaagagaacacccaggtattaacttaagcacatagcaggctttattgagttttacagaaaaagtaaatacagctgacacaacctcgagactaaaatttttggtgacatctctgtttatcccagacactgatttctctattcagttttgtgatgtggagagtattccgaaggcctgaaagtgttcaaaaccattgtgcatagcttcattttgggggagaatgttataatttgcttctgaaaactaagtaatctctgacctctacccacacatcaagaaaggttagaaatcagtcctaatcccaggaattgtcatcaatgtctctaaaattctaaagactgaatgaattttaatccaataatcaacatatttaatgtgtgcctgtttgtatataaaggactgtataaaatgaaagggagacagagagatggatacgacctgggatttgagttctggaaatcatttgagtaaatggggtgatgatatattgaggaagtgtaacatcaatgccatgtgaatagattgggcagctttggaaggtcatgaattggccattatgcgatttgcccaacacagtttatacttattcataccattgtaagaggaagttgatcatgggagaaaggttgaaatagatgtgtgtttcacaaggtacaagattggcacttctccaagtactcagatcatcttggatggtacacagtatacagacattaaaaagcactgagcaacatagttctcttacactccttctgagaatatcaaggggaaactcatggttggtcctagcatatctgaacacttttgaaatcctgagtaatccctcttttactgaaacaaaaaaagtagttcctaggctgagaatcctgggagacaagtttacctagctggaatataataccttaggtgggtttttatcacatttatttttatgattaccactatttatggcaagtagatactggtttccatgtatcatagcaacaagtttcctttattctttaattttgaactttgaaacatttaaaaaatattgtgactattggttattagaatgatactgaaaataataacagaaatgatctttgcagctaacaatgaccagctgtttaccatgcaccatcacaggcttaaatgtttcatgggaatttttacatttaaccttctcacaaaaaacctatgaaattcaggtgcttgttaattatgacccccattttagagatggcagtctggagcccagaggggttgagactcccaagtcacacgtctagcagataaagaggcaaagatttaggctgtcttgtagtacatcaatgtggccgaaatggagagacgtcagttcaggaaagcttagaatggatgactgttggtgatgctgagtttctgtgcttcccagaaggcaaagatgcagctgttttagggacagggagagaccttggggattttaactggaccgtgacagtggtgttctatcatgatagtgaatgagctagtagattccactttcattttctctcttagaaatattatgaagttctggtattaggggttaaagcaaataaagcatgatcctgccatcaccaaagagttgcaaattggatgcataataaaattaaaacattttttgtttctggcatggccaatattgctatttgtcttatagaaacctcttctcattactaaattatatattctgtatagtgggcccccctttctaattaataattaatattgtcttccaggcattttagttaccaagtggtaaaggaagcttctgtgatttcaacttcaagttatttttcacatattctttacttttgcttctgctttcagacacattaatagggacacatatttctcaatattaggaaaagctatttcaacaagtaaaattagaaagcaaacagaaaaaaaaaagaactatttaattataaccaaagatctaatggtaaatttaaagaaaatctcttaaatgtggttacattttttacttcttgttttatttctttcctacaccctccaacactgcaggatagcatggtaggaagggtacaggctctctagtgagccctgagctcaaaactccactctatttcttgtaaatgacattgactttggatgttttaatttactcctctggatttcatttttcttaactgaaaaatcaggataatgatactcctcagaattgtgcagattaaatgagataatcaatgcaagcagccaacagcacccaataggatgttgtaagtgcttaataaacttcttaagcatctccatgcgcccaatactcaacttagtatatttacagtttttcttctgggtctcttggtccatttctgtccacgtcttctttatttctaattatttctagagacagctgcactttgttattaaactattcttttacaagctactctgctgttctgattttgttatataaagcttcctgagtgctttatatattttaatgtttttttctcattataaaagttatattacttattatgatgctttggtaaaagtatatggaagtatagaaaataacaaataatattgctttaaataatattactttcctgtccttacccccattcatcctcacaatgccttatggaattatgttgaaattgtctcaggtcctaaattctcagaagaaaggaattctaaatcttatattagtggaaacatggagatcttgcatcaatgaaatatagcaatttaagaaacaaattttaggcaaaatgacatccaaacatgtcctttactttatttccttttcccaaagacatggtgtttctagtgttatatgcttaccatgtgaataaataaaatcacaaaattttaccagcccaagaaaagcatttctcatgttcatcatgcactgtgtcacgaagaacaattaaaattaactctgtgatctttaatactcatccagccccaggcagagagttattgccaggttattttaaagggctttcaaactgttgttcagaggaagttaaacctgaatcaaaccaggttaaacaaacacaagtttattttctcttttgagcaatgctgcagacaagggcaatagggtctgaacgcagcttgttcttcaggtggcctgaaatgcacaggttgttcagcagtttattaaacccaaatcttacaacagaaagcaaattatctctaagggaactttgtcaccagggtgtctgttcaatagtgatgtctattgccaccacagagactacacggaaaggtcaatgacaggtttgcctgaaattaccccgggaggaggtgtcttcctattgacctacattaaatttgttatccaaaatacctttttttccttaagatggggagcaaagccatcttctagaggtctcaattgactctttgtaaattgcaattaccacaaaacaatctttctttctataattcaaaataattaattccttcccatcatgctgagaatttccacgtatcttttgaaatcaagtatgtaagcttgggcaaatttcagctaaaagttaaaataccttttgaattttatgaaaagagataggcaaggaaattcaaaccaaaacaagtctttttttttttttcttttcagagaaaagtcttggtgttatttgctatcaggtaggtctatagcatacagcctacccatgccaattaatctgccaggcttttctaatttctcaactggcacaaagccagagacccctgtactgtatccgtatgtcagctcttgcagtcacaggctaattctcctgttgataggttgaatatatgaatctttatctctgtctcttcattgtcacctctctactccttctacattgtgactatttcttgggcattgtattccaaaattatgctgtattgcttttgcctcaagggcaagtaaagacaatgcctttctcataagcagttcagctttcaggcagaacagcttagaataccataggttgccattttggtgtagatcctcctctgtcttattttggttataattttaataccaaagtaaatatttatcacttggccagagtaacaagaaaaagatcaaatgagagatgtagtttaatccaaccaacaaactgggttaattacagaagaaattaaaattgcaggcaggccctaatcttttttttcctactggacttttattctttgatacattacccattaccacccccaaactgtcttttatactcctcatttgattgttattatatcaccgagagagcaataattgcaagtctctgttagctgctgttggggaaaaggccaagccttctacaggctggaaggaggctgagcagtgggcatgggaggtggtgccaggcccacaaaagcagaacccctcctgcgtatcacttcctctgcccctcgtctaagggcttcaaacaaggtctaacagccctggggggtttcctctcttgatacccgttatgggttaaacagtttccctataaaaatcatattcacctagaatctcaaaatgtgaccttatttgggccctttgcagatgtaatcaagttaagatgagatcatactggattgcataggccctaatccaatgactgatgtccttatgtaaggagagggaaatttggatacagagggaagacaatgtaaagagacacacatccgcaccatgtgacgatggaggcagagattggagtgatgcctctgcaagacaaggaacaccaaaaaacaaaagggccaacagccgccagaagctgggagtgaaccaaagggtttctcccgcagagcctccagcagcaaccaacctggccaataccttcatgtcagactgccatcctccaccactgccagagtatagatctttattgttgtaaagcgcctagtttgtggtgtgttgctatggcagccataggaaactactaccacaccacacccatcgtcccctcccactgcattgctctgttctctctgtccagtatgtcttgagtggaaacattgaagaggggatagatcgtggcctcataaccacaggctaccctaaatcccggccccatgtactcaggcacatgctgctactggtttaaagtcagggttcacagtctcaaaggcctgcaggggcctggtaggaacattaaagagaggttcaagccaggcatagacgggagctagaaaacccaccatctgctcaagagggctgctgcccgtctcctccagcctattggtgccctaaggggatatgttgccagtattgccctatcttcccatatgtcacaattagccaggaatgggcttttatatgaaatcatacaattattagattgttattttaattgtgtagaaaaagcaagctcatctgtggctgtgaagttcctctggtctattaatgacaggctcgctgacacgtgcccaattctgtcctgccttgtgatgtacgtgagacctttggttgggggatgcctgtctaaccgccctcattctagggcatcgctgatggcccctggggtcagcagtcttcctttcctggagccaggcctcctgtgacagctctgccatcctcccctctgccatcctcccagtttgcttaagctgagaagtagtcttaccgaaatataagttagtcgctcaccccttgcagagttcaattaactggagtgaggtctggtataaagaaagcgatttattccaaagctagcttggggaaagaaatacagatgtcctgccttaagtataccacttcacttttggaacagaaaacgggtacttttcaaaggtagaggaggaagcaagcaaaacgtgatagctctggtggcttatctacgaggtgttcgagcttgtgactgccggcacctttgtggacaggactaggctgcaaacttaccaggtgggaaggagtttcctatctcttgaggcagtcacctggtaggagggagttttataaaattgaggcagcctcctggtgggggaaagtttctttctggggcgcctaagcacatagttagatgaacttgcccggtagggagtgtctggtgaaggggaggtaaaaggctatatttgcatttctaaagggctatgtaggaagtggggaaccaggggaatgagaagagaaaagagagagaaaaaaataattaaaccatcttagaaaaatggggctacttggtgacagtagcagtaattattttaactatgtttgggattctgtaataaattttagctcttcaggagtttagcctccctcgtaatgtgtaaatctattgtttcactttcaggctttcagctttcaaacacgttttctggaaccaatcatgtataaaagagagtagaagccttttaaggccctttgagttttttttttttttaattgcacataattttaagtgagctattttattcttgatctaacaataataaagatgatttaaaatttaacataacagtttgtcacttttttgtgtattttgtttgtttgttgaaaggaaatgatcactccataatttctttctttgcagaaggagagaagtggttttctaagttgtattctgaagggatttatttctaaggaagtgtttcagtgtgacttaaaggcaagcaaggatacgctgtctccctctacagcagttaggcttcctgctgaactgctcagaaaaatcataggtctccattttgggataatcctcctcttttgggtgatagagtgaagttggcagctttcatcatgtgttactaaagacccccccaaaagaaaagatcagcatttttaaaggtcctgtgtccccagactggttttgatttataggactgacaatgtcaacttttcaatggctgcaactcagagcctcatgtgaagaaagatagattcaatttatctcctgagtccagatttgttcctatcctctgtggatccaaaatctccaaatgacagtgagggaacaactgcttctctatgctctaggtaatttactgtgttgtgaattagatgacctcttttcatgtagggaaaattaagtcttgtgtcatgtctgtatttgtactacttgctgctttatcacctttggcttttctctgttgccaccaataatttaaaaagggccacaggtaggtcaggactaacctgttctaagccaagaacagatttacattttcaattcttttcatcttactccatcactattcataagtattaggaggagctcaaagttcactatcaccctaatagctacaagtcagtcagtagtctaaattgaggaaaccaagatgagatggaccataaaggaaactttgaaatctcatccagaaacaaacatgaaaataaagctattaaagcggcgctgttgtctgaggtaatacccgacgtttgacatctcatgccaagaaaattaaggacacgggcacacacaaggagtgagtttagagccgaagtttaataggcaaaagaaagagaaagaacagctccctctcctgcaagagagaggaacattcaaatgggacttccggcttgtgttggagtacaccagattttatagacaggcttgaggaggcggtatctgatttacatggggcccaaagattggatagaccaggtgtgacgtttacataactcgtggggaagctggctggaccaccctaatattatgcaaatgaggtctttgcctggccagcaccaccctgttgtctgcttcttgctgtacacgtggctggcaaagagaagggacgatggagccactattttaaacatgcctagtcccaggtagtcttttcctattggcacagctgccagcattcacccatgcacgcttccagcttgctttgtctatgtctgcagctcgattttacaagctgctctttgttagaaaagaaaatgatttaggggctgcttttcgttaaaaggaaaacctgggccgggcgcggtggctcacgcctgtagtaccagcactttggcaggccgaggcaggcagatcacgaggtcaggagatcgagaccatcctggctaacacagtgaaaccccgtctctactaaaaatacaaaaaattagccgggcgtggtggcgggcgcctgtagtcccagctactcgggaggctgaggcgggagaatggcgtgaacccaggagttggagcttgcagtgagccgagatcgcagcactgcactccagcctgggcgacagagcgagactccgtctcaaaaaacaaaaaaaggaaaaccttaccgaggactcccgtaccctcactatctgcctaaataatttctccttaactcctgtatcactatccttggactggatttaggtactatattcatgaaaaaaaaaaagaatgtaatattagtggaaaaaccgtttttctaagttggtagaagatccaaatggaaaggaagaaaatatctaagtatttatattgagttgcatttcaaatttttccttgagctagccaaatttgtaccccaaggccgaatgctagctttatagcttatttctggcttataaaaatcccataaaacattggccgagtgtggtggctcactcctggcatctgagcacttcgggaggctgaggccctcggatcacttgaggtcagaagtttcagaccagcctggcctacatggtgaaaccccatctctactaaaaatacaaaatattagctagacgtgggggtacatgcctagctatcagggaggctgaggcgagagaatcgcatgtacccaggagttggaagttgcagtgagccgagatcgtaccactgcactccagcctgggtgacacagcaagactctgtctcaaaaaacaaaaaaatcacataaaacacattaaaagcaacaggtcaaattgtatacttagcctttatatgcagaaaaatatagccaaaattatgtgatacagctgtgtatgaagaaatgtcaggtgcttttttcttcatattcggaactgtgtggttattcttccattatagatagcattcgtcaatcttctaccgaaaagttctatcaaggcagtcatcacggaatcatcttcagaatccattccttccattctacttttactaccaccgtcacctgaacaagttcagcaatttcttggaaagattgcactcttcctgttgtcagggctgaaaactcaatttctaacatcttatattattggcttatataactggggcgtccaaggtgttgacttccaccgtggacagaaatgggctcaaaaatgtcataaggtctctgcttctctttctctctctctttctcttgggctctgtttgtctttggatggcttccttaaggcatgctttctctatatggtaggcaaaataattgccaacaattctagattcccatcttccaaatttagcaatcccagcagaaagagattgttttctcaaagagctcctggttttgatggcatgcttctacacccatcactatagacaagagaatagggtctcctgactggccaggtctgggtccctgcccatctttatacctagatagtttgtcaaacagctttcccattgaaaacagtaatgctcattttactgtgtgcttatagaaatgtgtatgttattgtatggaacacattggcattatttctagatatataatcatcaaaagtaatgatttattatgagcttgagaacaaaaacaataattttcacatcactaaaaaaaatagcacaaagcttgccgggcgcagtggctcacgcctgtaatcccagcactttgggaggcgaggcgggcggatcacgaggtcaggagatcgagaccatcctggcgaacacggtgaaaacctgtctctactaaaaatacaaaaaattagccgggcatggtggcgggtgcctgtagtcccagctactcgggaggctgagacaggagaatggtatgaaccctggaggtggagcttgcagtgagccgagatcgcagcactgcactccagcctgggtgacagagcgagactccatctcaaaaaaaaaaaaaaaaaaaaaaaaaaaaaaaaaaaaaaaaaagcacaaagcctaatatataggaggtatttagtaaagaactatgaataaatgggttcaatatatcatcccccttctgtgtctatttggtgtcacccatatgctttgtgaggcatcataatgtgttgtaggacttcagagtggcagaactactcagcagttgtcttagtcttaacagaatcctttgtaattgcttgaaacagtgggtccaggaaggcacagagcttcacttaatagaacatgtggctaactctggtctattcatgagtgtctcactgacatatgcccaagcacctgtcccgcctggtgtattttacatgtcaggcatcgttctaagcaccgcacatcttaacaacaactctatgagatgtatatagttacttttattatcccatttttacaaacaaggaagctgagttacagagagattaactttcccaaagtcacacaacttctaagtagtagaagcatgatttgagcctagacagtttagttccagagtttatgttcttagttactacactatattgctgtataaaaaagtggttgagtttctccaaagaatagtttatcaaacttcatattacccccacatttggataatagtaagaataagcggtcacagcaatatgttgtgatttaatgaagactactgaaaattaccccttctacaaatgatctccctcactgtctttctctcatctggaattctaacagttagggtcttacctctcttacttacctctttgcaaataacagtgggagagttgagaccctaaaccaatatcaggcactgaaatatttaaaatgaatagtataatagtttataaaaattattttgtaatttcacaaggcccataggaaattggatagggaaactctgaggacaaggggcaaagagagccttctactacgactgtgaaaagctagctggcttttatgcaatgcagataccaaaagcaggaagcaggatggaaatgatggtggggaaaacatttgaagagtgtgaagcactttaagttaacgaaattttcacctatcttatctcattatagaagaagggattttaaaaactgaattagaccagcagttctcaaatggggtgattttgacccccagggtatctttgacaatctctggagacatttttgattgtcatgacgtggggaagggttagagctatgggagtccagtgggtataggccagggatggtgcccattatcccccccaggacaaagaattgttcagtccaaaatgtcgtcagtgccaaggttgggaaactctgtctcagagcttgcataagtaacttggctatgccatatacttgacaagtttcagagtcaaggctagaatccaagtaatctgatgacaagtcctttgcttgtttccgtattcatttccttcagcatgtcagagtttgatacaggcgatggctttaggtttttggaatgatcgtgatactgtttttaatggtataagttattaataggtgtttttgcttttaaagagtcatctcacccctcagaatgtttaatatgctccaagccagtgttacctcatgaaagataagtctgtacataaaacacaaatgtcaccttacatattgaattctcatatgccagtgtttcacaatttctagcaaattattttataaatggaatgtgactaactcctttaaagctatttttgttattattgaggtaattaagatttgttcaccactctgtttttgtcagtgcatctgctccttggcaaatgaggtatcagatggtctttactgagcaactgttatatgcgtagctgtgatgtgaatgaacaaaaggccttcttgtctgtgtcttttttttagccagagcttggatttagcttacgctaaattatttttttaattgtagatttgagatgttttattatgagaagttggtaatcatctgtgtaaactaataagaactgaaaattcatcatacatttacttatttttttaccttgatcttctagtaaatgtttagcttcatagatttaggctgctatgtaagaacattctcctttatctgagtgatgtgatttaacagagtaatttgtttatgagcatctcttattctttctttattggcaggaggacttgcacctctgcttctcattttgtcactttgggttcagacacctctgtaatagccatcactgggggcagatttcagtagactttgaaaaacttgttttccctgaggctccatatgcttcctggtttgcaaaatataatgacccgcaaatccttcaacaacagcaatggttaggcctagcagttaccacctcactggccatggctccagctcggctcccttgcctccaccagaagcatgggtcaccccagcccaaaggccaagacctccaacgccaggcctctaccagaaagcaacataggcaccgccagcaggtacaaactgcccaaccacaggtgcccttgtgccttgtctgcctcttgtaccttgattcgggatgactcagttaatttgcatattgatttcaaattgtcagaagtaacagtcaaaatacaaacagaaggcagaaggctgatgtaattactatattaaaagaaaatatattaaaatgatgttgtccaatttttcctatatatacaaatgaccaaataagagaatactttttttttttttttttttcgagacagggtctcgctctgtctcctaggctggagtgtagtggtgccatctcggctcactgcaacctccacctcctagattcaagccatcctcccacctcagccccccaagtagctgggactataggctcaagccagcacacctggctaatttttgtgttttttgtagagacagggttttgccatgttgcccagactggtctcaaactcctgagctcaagtgatcctcctgcctcagccccctaaagtgctagaattacaggcatgagccgccacacccagcctcgcaaacacaattttaaagatgaaagagaaccactgcctagtaaatatcaggaaacctctaggaaccttactgaccctatcttacctaattcttgctatcaatctataagatggacattgttagttctgtttcatagaagaggaagtaaaaactgagaaagttaagtaagttgtctttagtggtacagctagaacccacagctctggaatgtgaactcccatccctctgattccaaaattctttgtagaattcttccaccttcataccctctcatcagactgagtcatagatctggaccgggtcttcaggaagactgtagcttctccatctgtaagagccttcaaaaaagtatatgcagcatttgcaacccagcgcatttacatcttcacctgtgtttttataatgcttgctcaaaagttctatgaagtgaggctctgcccatcctagacccctgtttcagatatttgaaaggactctgttaagtatagcactagtgccaagtggttcaaccactctgaattcctacaacgtattaccgatttttcccttaggttatttatttattcatgtatttactcggccacttaagaaatatttctagtatccactacacgccatcctgtgtactagacccaggaggttcagtcgtaagacagacaccatcccttccctcagagatgctaccattccatgtgataagacaactaagaagcaaacaaataaaatttcctgattgaatttagtgggaagaaataaagtggctgcaggaaaacagggagacagggagaaccaccgtaaacagtgagttgggagagatctatcaggaaaagctacctctacactgagatcctgaaggtgagaaggtgacagctatgtccagatacagggaaatgtgttcaaagcaagcagaagagcaagtgcaaaggccctgaagtgggaaggatttcaaatactctggaatatgcagaaggccagtgtgactagagttcatcgaagggtagaaagattagaacaaaacagtaagcaagagaggctttttaaaaagctagatccattaggcttcataataaggctccagcaagaaattttttcagaatgcaatggcagagccaaggatatagctttaagccaggagagtgatataatcggatttaaattttaaaagatcatctggccactgactgaagaatggatttgagggacaagggtagaaataggcaggccaattaggaggctgttttgatagactaggtgagaaggagggcgtgaaagggatggaaagatgtgagcagatctgaaataaaagagaaatttaacagacatttaccttgagtgagctatctgtgtacattttttacttctctgacaagcctctaagccaagctgtgtgtcttattcatctttgtattttcctacttctcttctggtagtcatgatgaaaacagagttcttcaaaattcttcctcttccagattttgcatctgtcaacaaaaacattttcttccctgcagaaagtagatgtttgtctctaattgtggggcctgaggtttgccatccacatttgctcttctgccaaagtcacgctgagtcgtggaatattttaattttttttaagttcagtttttacatctcattaaaaatgtgttggctgacatatttcagaaataaatatgcttaataatacctcatttaatttaaggctctcatttagaaaaaaacactttcaatgaaaagacttaaattgattaatcaagggattttttcgtattccttattagcagttataagactaatggtgatctaccgtaagccttccctttgcctaatgtggttagagctaccaaagagaaatcgttacaacctgtctaatatttataatggctattccaactgactgttgagaccattttagcaagaaaagaattaaaaacactaaacaagtcacatgtctcaattatgtttatgtatatgtggacaaataccctaaataaagatgaggctgtcatctttactacaaataatgtagcaatgatttatggtttgaacaatgacagaatgacagaactaatttgcaataggtcatatgagataaatttcaccatttttggttcatttactttgatttcagaattaccatttctgaagatggaaacctcagaatcatcaacgttactaaatcagacgctgggagttatacctgtatagccactaaccattttggaactgctagcagtactggaaacttggtagtgaaaggtaatggctaacccaaagaattcgaatatttatatatgtgtcctcgtgtctaataatgtaatctaccgaagtggcatcattcatattaatatgtacagataccactgtattgctaaattaattcatcacggcaaacatgatatgattaataattcttagaaaactgctggtaatgaatatgattgaaaggctatcttatttcagaatcatccaatacaattttgagaattatagccattgtatctcttatagtattgtaacgaatgttatcttcaatcctttaattaaatttctttcaagtctctatagatttgaaattcatgtctaggaacactattccaacaaattaaaaactcaagactcatgtactatttttagaaaacattgtttaaacaatgacattggtaatttttaagatagctgtcccatttattcagagatatggatatggcttattatactaatagaaggctttgatcacctctatgctttgccttagtcacccagccaaccttgtcagttttaaggaaataaaattcccatataccatagcctgggtgctttataatttttgtagcagaaagtcctttatgctcttagcaaagcacgtgagtgaaactatttcaatattagcttcatggcatgggctggaagtgctaagtaaccattgaaaaggagaaaatcttaatttacatttcatttgcatttctttcactttatatattgccctgtcataggatttttgagttgaagggatcttgacaatgatttgactgaagaagatgaggctcaggttggtggttctctcaaggtcacgagtagcaggagacctgaacccagatcctgattctgagttcttcttggtcctttatgctgcaccaggaaacaggaagcctttcctgtttctgagtaatttatacagatgggtcatatcatattatttccttcttgcccatttgtagttcccttggtgaagacagatgaaggcaaataaaaatatcaaaaaaaacaatttgcctttaatttaaagaagaaagctaaaaattacctaattaaatattttagggtcattagaagttggaaatgtactactcttttgggaagtctttttatcattaacatacttgaccatgcagatagaaaattggaagtccaagagttagaactaaatatatgtttagattgattacaactatttcagtctattaattacttcctcagagcactagcatcagtgtatgactgactgcttgttcactctgtttcataggcaaaggaaaaagaggttagataatatttgtaaagtgcagttctagctagaggtttttgctaatgtatgactgtcttggctaaaggaagtttagtaatcatttaggaccaagagagatctcaatgtttcagagctggttagacacagagctgggatctgttatagattatttgtgaattatggagatataagagaatattaggttgacatcttaaatcatagttaaaagacagggattcaagtcagagtgatctggatttgagtctcatttctaccacttaccagctcttagacaagacacttagcctgtgtggggataatagcagtgccagtctcatggagtcgctttgataactgtgaaaatccatgttaagtgattagtgtggtgcctggcacctaggaaatattaatagttgttttgtttataaacatgttttcataaaatgaggttgttctgatgactgtggtaatccatgctaagcgattaacagggtgtctggcacctaagaaatattagtatttgttttgttgtttatatattttcaaatggatatgcgtgtattctaaatcctgttgaaatgaacatttatgatatttccaccccaatagaataattagcatagagaagtgagcctataataaagaaatgactaagaatatgaaagattcaaaacagctaagcatagaaaccatatatatggtgtctcatattgttaaaagtagggtattttcacaggtaggaacaaggtatgttctgtattttattatcatccttcttataagtattggcttccttggctctcccaagagttggcagaaaggagaggcctctatttcccatcagagtttgcatcccagtgataccacaagccccaggacaaaaccgttcccaaccaactgtgcagatccctgctgctcatcttacactgaatcacgatgcaaagcctacaaatatatcagggattaaatacgttatagttgcctcatttttgtgtggttataaatattgctaagatagtaatttctacctattctaacaaacaaaataatttatttcttgccttctagtaaaatgtgaacaagtattcacccaagtaagtataggatatagttttaggcagtttacagttacaattttttaaaattttattaactatttgtttctttcaaggtatattaggagaacactagttttccactaacggcaataataacaacaatatttcaaaataaatttacgtaaagaagtgagtcggtacaaagaaaagtactaaatatgcattgttataggaggatatgcaaaaaatcatgaagatggtatatgtgaatgtctaaaactaggaaacatgacttgaggacaatttccaggagagttttagtggacttatagatgcagaattagtatgtcctgcctatgctagccacatgattcgctgaaacatgcacaacactttaaaaactgaaatttcctaataggtgagagaacgaggagggactgaggtaggaagagcctggcccagtacaaaaagaggaaggcagggatgtgtaggtatgagccatgaggttaagggatgatgtgcccaggtagcctgattgacaggtagaattcatgtgtttccaagcagagttatttctggcagtggctcctggttctgagctgcagttagtttctccacagaggtcctctgattcttatattcttcttctaggtgaggtgggggaaaaaagttttatttggccaatatgttctcaggagttaacaatcctgttactttagataaggtcagaagagatttgggggatcatttatctcccagtgtggttggttctcactcccattagcattaatgggaagtacgtgtgtctgcagaggggccatccacagtgcgaggtctccaagaaggacattaacataaactgagaaatataatttaaaaatctgccccataaagcacgatataggcagagaaaaccattctgaactccgcatgaactgtgccaagtcctgaatcccacatcaaaatgcttgagccctgcacctttagtgcaagtgtaacagcttagcccgaaatatgactgagcgctgtattttaattcaattttgagatctacaaagggactaatttatcagagaaggtgttctgtaaccttaaaatgtgcttgtattctttccgatttcctcatgtgtctgggattaaaacaccgtgaaggtcgggcgtcagaacatatcttttctaacctttttacaatagttctatcattaaccatgctttcaaaatccaattctctttctccctacccttgcccccatgtttcggagagaggctgaagatagtgtcaaacacagggtcagcaggtaggggaggagagggaggtggcacatctattccaccagatacaggaggtttagaataaacctctgacaagcaatcatcacatgaataaatattcagattctgcatgagcaggctcccaaactgcagaattctgacaggtgcccagggggctcttgattatcatcccatcatctgaattcctaaattttactggttttgtttttcaggctagttataatatacttgggatttggtttgctgtttcattttaagcaagaacagttcttaagtcaaaccctcaaatactcacagaaagcataatgttagacctttaaacaaaaatgtgcttttgtgatcattgacatcattaagaactctacagagggcagggtacatttatatgcaatattgtacttactaaatcatgtttatctctacagcagagttaaaggggtggtggtgggtggggattttgcatgacacagtgcctctgctatacaggtttcatatgacagatatttttaagtagcagtcctagagaagagcaatttagagtatttgtttggatgtagttcaacaagataactatgttaatagcaaccctcactcctattgattatctccaggactcaaaatgtagggcagtatgctgtggatgctgttaacatagtcatcgtgctgaactacatccaaactgaccttgagcaattttgcaactggtggttccagactatactttgggaaacactgtcctacaccaaagaacttcgtacatgcatgccacctagcaagtgacagttcagtagagtgcatattagaagtgcagatctcctgggcctcactcctaccctaacaaatctaactcctagggaggaggcctggaaaaacctacatttaaaataaataccccaattgatccttatacacatcagagtttagaacattgcattttcaggggtttcacactatgctctgtgggccaaatccatacctgttttatataccccaggggctaagcatggttttcacatgttagctggttgagaaaaaaaccaaaagaacaataatatttttgggcatgaaacttttatgaaattcatcttttagtgtccataaataaagttttgttgtcacatagccatgtcatttttttacatattaactaaggttgctcttgccttacaacagcaaagttgagtaattatgacagagactgtgtaatttttttttttttttgagatggagtttccctgttgttgcccaggctagagtgcaatggtgagatctcagctcactgcaacctttgcctcccgggctcaagcgattctcctgcctcagtctccctagtagctgggattacaagcagatgccacgacgcccagctaatttttgtattttttagtagagacagggtttcaccatgttggtcaaggctggtttcgaactcctgacctcagatgatctgcccgcctcggcctcccaaagtgttgggattacaggcatgagccactgcgccccccgagactgtgtaatatataagtacctatataatatcctcaactttgccacttctgcaaaaccttaaatatttactagtaagtccttcacagaaaagaaaaatacttatcctctctttgataactttttctcttcctcagatcttcaaaattctgtccaaggtatagtctggccaagctatacacaacttttcttgtacccctgctgatcttgcatgctggaaatttccacatgtccttgagtctgattattagctggaagtggtagggagttttctttcccaggaccttagcctcaccccagtatccaaacagttgactttagaacttggatacgagttgaaaatccagaggagagataataaatcattgattgagagggaggaggaaaattacttggcagacactggaacaataattcaatttgattctccagcatgtggggaggattcacacagctggaaccagaatagtaagctaagaagaccctaaagtaagaagcacatgacctggtgtttttttaaaacacttctctcttcctaaacctcccaccgtcaccagcctaaatcagcagaactgttccacctttacctcataattctcagactgcatgttcttcctctaatagcaatttttttttattttgaaattgactatataaagttttaccctaattctgtctggattttaaaagagttcttttggcttttctgtttatttaaatgtctaaattcagtgcatagaattacttttataataagaaaaaataaatttatactttaagtagctttaatagaaaagaagtctttagtggaaattgactaagatcacagatacacgtaacaagaaattattttgtattttcattcttcaaccctacaagccgaaaaggttcctgtggtttagctgagcatttaacggattcctttattgccagaaagagtgctcattgttcaccccatagaaagtttatttatgtttaaatcaacagattttttcatatatatatatatatatatgtgtgtatatatatatttgtaccagcaccaaagagtatctacagcattactattgcgcactatataaaattcttctgttttaactgtaggacattgggaaatatcaacctttccatgcatagcataatagacgcaataaagtagagtcttttcagttggaactttattttgcaaatgagtttgaagcagcccaatcttctatgtaaaactgttcaaggctttatacagatttgacaggggatcaatcagaaatcagtaacatacaatgacggttggctgctaacacacaacaaaagcttttaacattggtcccttataactgaatacatttcaacccaattagatatcttccactggaaccaattatttctgggtgataattaagggtatttctaataggattaacacaaattgtgaccctaggcatctagagtaggaaggaaaagtttgtcattagaagtgctaaatgctaattatggtaggtccctcagtagaagaacatctggccagaacatttcaatactagatcctgttagatctgagatctgtcaccctggagttggtaccagctatggtaggagaatcttaaaagaagggtaggtaattgtgcatcttgttcttcctgtgttcacaaagcgtgtgacataacctggaaatctgatgaaacagggtgtgattatttcctctgacattcttatggacatgtgtgagagccacgtagattgagcaaataacatgcctttggcgatatcaatcatgagtagaatgattccccttttgtccaaatctctctgtaaaaaccttctctccttttgtaatgctgattgcataccatgacagtctgccctgactccagcctgcccatcacttctccatccttggtctagagggaagatgtaattccttaactgttacatttctctatgccaactctgtctttcgtagcaaagcctctatgctgaagacaggcctcgtatttttgcttttggcataaaagacactctgtgggtcaagaagcttgtgtggtaacatcacctcattaataatcagggaaaggcaatgtaagcatctgtgtggtgtgatttttttacatatgagactggcaaaagagaaacatctaacagtaccttttgttggtgactatgtgaggaaaatggtactcacacactctcagtagggatagaaattgcaatagatactgtggagagcaagtaaaattgagaaagtgcaatctccatggcccagcaattccattttctgggcatttaacctagtgggattcacacgtgttctgaggcagacttgcaaaggtgttccttgtgttgttgtttgtaatgaaaagaaaatacaaggaaattaaagaataatacatatggtatcattttatttaatatattgtatgattaaatataaaattagtaatataaaataataccttataatgtttgcatacagaatacacatgcggcataagccctaactcagtatttggagggaggatgcctggagtgagattatgtgaaaggactttagctgtattggtaatatctgtttgggtaaatttttaatatatattcatggggggaaaaaggctggaggtacatgaaaatgtgttaaagccttctaattctggaagagggaatatgagcacatattggtaaatttttgttgtagttttatatgtaaaatatttcaaattaaaaagaatacctcaggtcagaatcctacatggtcagatattgcaggcaaagccatccagacaggaggtctgttttttcagttctctctcagatattgtagaagagacaccttttacctggtgatatttaacccatcccatacaaataatttctttcttgtaaggaaaaaactctcctataaaatgaattaatgaattcttttgtaatgaatatttactaatcagaataaacaaaacaaacaaacaaaaaaggcaaacagaatatgactctttggcttcattatatgtgaagcacataattaatttcttttccagcaattcaaagagacttatgttatactgattcagtttaattgaacttattaccacaagaagataataagaaatatattgaagctatccatctggcttgcattgaaaacctcacatgtttcattcttcatgactgtcataggccatactaattgcctcatttcagctgttttataatcagtatgatttagctatgaatgcgataaaattcttactccagaggaagttgatattaaaaagcatagatctctcacctagctctgctaccacttctgaactcatcctcagcattattacagttatatatttttgaaatacataaataaaaatctatctttttctcgtgcatatctttttaaagtacatctgtcatcttccttctgtcatcctgccatagagctattcctttactgaaggaaagaaatggtttatgttaagcttttcagttcattaaatgtttaaatctcaaggtaggttgttttcaaactatggagtctttaaaaataatttccatagctgaaatggagtttaaatggctaattgtgtaataaataaagagaaaagaaaacttaggcacttttaccttctgtctctaaacatctgaacttcctgtggcttgagaatgatgctttgtcatgtagactggttttatgtgcacatgatctctcagaagaagacgagtttgtggtatgtctatgtgtatgttttaaatcatctgtctccttgtatgttagaggtggtcccatggggggagccaacagttggtcccaggtctgaaagggaaagcttggtttcttataaagcttgaatcagaaaggagacgtgtcagaataattcatgagtgactctccccttcctgttttggcatttgttttctgtgccagaggcaggaggagtataactctcaaagaggcagtcctaccaaatcacgactgaatttctttggctgtcgcaggcaatcaaatttaagaaaactgcccaaaagactttaggcctttaggttaaatacagaatctgaccaagatgaaagcaagttaattaacattttcatcatctctctctgatttactgtagaagatccatttctaaaaagttaaaatggttgtctcttttatgtatccatttgaggaggtgaaagtaggttcctggttatgggagaggaaatgtaagcagaacatttagagttaacagtggctttttgcttggccttctagcaggtctataatcagtgtgcaaaagtgcaagacataattaagtgaagattagcaacattgctttgaagatttcccaaactggaaaacataccaactgtcatcttattaactttttccccttttctctctcttcaaaagtagaactgcttataaatgtaagtaaagcttggattctacctagaagaggaggatccaaagggtcaaatcagaactgccttctcctccatgtatactttaataagcctggcccacatctctcctgatagaacatgtatctgcctccattggctttgtccacagcatgggtagaacacctggtcactgtgcaatttgtaccaacacttcaacttcttcatgtgtaagacaaaggaaattaaattataatgaccagtatagttgatgaagggacactctgatgcagtccaaatatgagggaatagtcaaaaggtacaaaagacaaaactgtctcctccctgtaggccattgtgagccgtagaccacaagcatcagaatcacgtaggagtttttaaataaatgcatattcctggaccctacctctgacctgcagaaccagaatctccagggatgagacccaggaattttcattttcaacaagttcttcagggaatgcctacactcaacaaagcctgcaaacttaggagctcaacctttaggagtagatactgataaacaaagacacagagctgtgttcaaagtacagaaggaacacaaagggaggcaaaactaactaagaggtaaaggtgacaattgaacagggaattgaaatatgagtaagagtctaccagattaaaaaaaaaagtcaaggtaatcccaggaaaaagaaatgtatctaatggccccagtacatgaaggctcctagcatattcagggaaaatacagtggaaaagtgaggggaacacacccatagctattgctcatatttcaggaactgtggaaaataggcaaatactttgattccctttttaatggaaataaaacagatttcatgaactgtagctaagtgacatgacgccaacttcagtagaaattttgcttcttctaagagacattagaatgaaaagtagttatcaccagcatatgattttttaaaattatgttgtaattatattatttgtagaaatattagcaaaaagataatctcatcattcagagagatccacataaatattttttatattttcttctagaattacatccaggctgtattcaatccatatctacatctgtatcttaactgtgtatgtatctgttctcagatctgtaaataaatatccttatcacaaaaagatcatactgtatacactgtttgtaacttcttttttcattagtatctttctaccagcatagattattttgaacaataaataaggactagcctggtttctttatgaatatgtttctatctcctgctcctcaaaatagcatcagcaaaacaaaacaaaaagaacaactcttgtaatatctatgtggggaagatagaagaatctgggggatgtttaggaggattgtttcacatgtttcaccctgaaagtgttggtttggggattgtcttagtccacttgtgctgctataataaaataccatagactgggtaacttgtgaacaatagcagcttctttctcatggctctcggggctgggaagtccaagatcaaggtgctggcaggtttggggtctagggaggggccaattgtcagttcctagatggcaccttgaatactgcatcttccagaggggaggaacactgtgtccagaggggaggaacatggctaatttgtcctgacatggcagagaggatggaacagcaaaagaagacaaactccccacacgaaggtcttttataatgacacctaacctcattcatgactcagtcacctcctaaaagccgtacttcttaatagtgttgcattaaggattatgtttcaacatgaattttggaagggacacaaacattcaaaccatagaagggatttatgtcaatgggggaatgaaatccctagccattctctgccctttcctcaaacttttcctattgaaatttcttatcagttgacacatgctgttactgataacatgctgagtacattctctgatcacatgaatcattagggaataaactaaatatcagaagtagtattcaaaattagtttgaaagataatcatgtgaaccaagtgtaacaagatacatcttaatagtgataaaatataaagatttgcatttttcttcaaaactcaggatgagagagccaaattttagtgtcaggttgtgataggtcttagatgactataacatcatttatgagtctacaatatatatactctttaaaaaaaaaattaaatctagaacataatagtgtccaaaacaagagaggggggaaatatagagatctactgataaaaatacaactggaagaggattgcttttaagatagacattaaaatttgaaatcaccttaaagagtgacaactgggatgataggaacagctgtagaaactgaggctgggtaatccaaggaagagaagacttatagagggtgggaggggaggggtggtcagtgttttcaaacatttaaagagatatcaaactctatgtgacatcagagggcagtaccataagagatgagcaggaactgctggagcagaggatattacttacgtttgataaaaggaaaattttcaaacaattaggccattggcctattatgtatgacattcatttccagactagacatctactctagggaaatatggcagaaagaattcatgtatcagatacaagtgtgtggtttgagtagcctgtagggtcattttctattcatcttagcgttctcagggtctgccctaagtaaatgttgactcatatatcccacccaactctgaaatgttatcattctctgattttatagcttggaaaacttacttctgccctaatgtgcttctactccagagcaaaagcatacccctaggttgaattctgtcacactgactttgttttcttactgtagagtctttctttctttcttttttttttttttttgctttcaatgtgaatttatccataatcagcaatgcagtatgggttgaaaaggttattccgctaattttgagtaatatattctcaagtaacctattctcaaaatagagtccaataaaagtatccgttttctatttaatcatatgttgggatttgaaggggttcaataaacagtaccttgttcagtgcctgagttttgaaacacttgagaagtaagttgaggcagttgggcagatgaaaatcaaatgtcagctttgctagtgataaaggggaatgtggctcagggacatagcaataatgggcttcctaacactgaactccaaattaagcagacttttaccgctacacaacctcaagtctctctcactacgaaaagaaaaataaggagtggaggatcaacgcaataggtgtacatccttcactcttccaggagaaagaatggcactgagccaagaattcctcattgttttttcccagatgcatcactggataaggagtgagtaagaggaaaaaagaggacaggcatgttaggaaacatcaggtgtgtttaaatgtcagctatagaccaagggttacaaactggtagctctcatggctaatttgacttgaacccacagacttgtattgtttggctgtcagagtgtttaaaccttttaaattagaatgcctttagacagggggcatgtattctctaaactgaccccagacctaattattccgtattatcttatagctctaaatcacatgcttaggatactgccacatcctctgtaagcatttgacacgcagtattaagtgggtctcattgctctatgaaaaaaagccagctcttgattatttccaatttttaaattattaagtagatgcaaattgaccatgatggggatttgagaagacgactactagagaagagaatgtttcaaatctttctatttataatgctgtacatgattctacactgaatctgcatttcactcccatatctataccagaaggttatcagtggaagagaaattcagttatctgaatggacatgatcttctcaggagcagtcagtggttaattgggacaagaaaacacaagtcattatcattgagaaatctgaagcaaattgaggcaggttgtcacctttcaccaggaaacaaattagccctgtctttaaaaagacttctttctctctctgctgactggggattcctgtcaactgccaatgaaatagggagagtgtagattaatggtactgtaacagtggccatgaaacaaccataaagccgttttctaatttttatgaatatttttaattgattcgaccagtgtgtttgaatgacaaaatttgtgctaagcttcagctccagaaaatcagggtgccatcttccagctgaaatcagtaggtgcaccagtctgtttggggaaagttctgtgtataaagaaaaagccataaaataccgacaaagtagctcttcctcttggctaatttaccttcatgaactccttgccaactagggacgaatataattcaggtttagctcaaaaaagagagaaacagagatagagagagagagaaataataaaatagtaggtaacatcctgagttataagggttgcaagtaggataaaacttgagatatgacctactttttctacaatttgtgaatatgggaatcattgcagtctaatgcaaagaacagtgaactgaggtcctgtacatctgggggctggttcccagattccagttttctcacctgtaaaatgaagagcctttaatcgagaaaatgaagtccccttctaattctaaagttctctgatttgatgaagaagaagttggaataaagcattaaaacattccaatttcaaatttatttgttaacagtaacaacaaatttatccagagatattctaactcaggcacccccaaaaatgagatgaaatttttcatgtgcaagagatttctattttatgaacatttattttacatgcatcaggttatggtcactcaaggaaagagaaaaattaccatttaaatcgtgtgggcagttttaccaaccagctcatccacgaatggtcatgcgatgaggacctgaaaggacattggactcggtttgcctcgatcttcatatacctgtcaaaatgtgatgatcttgccaggctgaatagaactgatgacattgattttacacagtatggccaccaaacacaagcaagccacttcaaatggctcatagagaaagggctagagagaaaactggttcatttgaacagcatattgattccaaggtggtgccttcctgggagacttctaagggcagttttcagtatataaaatgttttgttttagatactgactttaaaactgagccatgtgtagatgtatcagaaggcaaggaaaacttgtatacaaatgtccatagaagcattattcataatagccacagtgaaatcaacccaaatgcccatcagctgatgaatggataaaccaaatgtggtgtatccatacaatggactattattcagtcattaaaagaaatgaagtactgatacatgctattgatatgtggatgaaccttgaaaatatgatgctaagtgaaagaagccagacacaaaaggccacatactatatgattccatttctatgaaattcccagaataggaaaatttatagaaacagaaagtagattcgtagctgccaggggattcaaggaggcaagaattaggactgactcctaataagtacagggcttcttttggggataatggaaatattctggaattagatagtagtcatggttgcaccaaaaaaaaaaaaaaaaaaaaaaaaaaaaaacaaaaaaaccccactgaattgtatacttcttaaatgtttatttatttatttttgagacagagtcttgttctgtcacccaggctggagtgcagtagcatgatcatagctcactgcagccttgacctcctgggcacaagcaatccttccacctcagcccactaggtagctgggattacaggcgcacgccagcacgccaccaagccctactaatttttctgtattttttgtagagacagggtttcgccatattgcccaggctagtctagaactcctgggctcaagtgattctcccgtctcagcctcccaaagctgtaggattacaggtgtgagccaccatgcccggcctgaagcgtatactttaaaaaggtgaattttatgttatatgtattatatcttcaattataaaaggaaaaaataagtaatgatctattttgcacacttaaaaaaaaaaagaatgaatgaagacaaaaaggaagtaatgaagcaaattcatcagctgtgatctccagatgtcctagatgtcctagagcttgacatattcttaggggtcaccagcttttctcctctcagttactttggtgtttttcctgatccagcctctactctgataacagccctccactctattcctagaaaacactgttggagaatagtccccccatcagtcttccacccactgtagctctacaaaatctgggcacccttcctctctatttctgtgacaccgtacctgatatttaaggcagagttactggacagagaaggtctctgacagatccattacagtccatctgttcccttttcttctaatgtattatagagggaagaatataggctttgaagatagacaaatcaggttctaatctcgacattaccacctataagctgttgaaagtgcgtttgtaaaatttatataatagtacctatttcataggatagttgggaagactaaattagatgatgttttaaccttaatcagcacacaccagcactcaaatagttactctcttctcttgctgtactgttcacagcccaccaatgagaaccccagtgtctggccaaatggccgcattctgctaacatcttgtctatgccattgtgtacttggcttcacaataaagcctttcagacccactggggcagtggtcctgtacctgtagctcttcaggggtcagctgggtggctctatccccatgcctttgggtggaggctgcctggtcggtggaagcaagttgaagctccttcttttaaaattcaagaggcagccctgatgatctctgaatcacctttagcgtcattcttcccttgtcttggaaataagcacacattcactgccaaatagctttatagtcttctataaaatcgaaaaattctggtagcccttcttcagttcttcccatcttcttcctcttcagtttaaattggaagttttcctgctggggtggctgattaagtcagtgattcacaccgaggctaatctccttacccaaaaatcacttggccacatcctttgtattctcttcagaaagtgcttttccctttttatttttgtctttgcaatatggataggctgagatttttttcaaatgtttaatttctacttcctttttgcttactaattctgtcttctgatcatttctctcttctcacattttgctataagcagtcaggaggaaccaagctactccaaactttgcttagaaatctcttcagctaaatatccagtgtcatcacttgcaaattctccctgccagaaaacactagaacacaaacacaattcagccaaattatttgccactttttaacaaggatccccgtttccgcagcgtaagcagaaatttatttctcacagttctggaggccgtggtctagagagttcaagaccaaggcactggcagatccagggtctggctagggcctgcctcctggtttggaaatggtcatttaccactgtatccttacgtggcagtaagagaactagccggctttctttcctcttcttataagggcactaattccattcatgagggatctaccctcatgacctaattatttcccaaagaccccacctcctgataccatcacattgggattagagtttcaacattggaatttgggggttggggaaacaaacattagtcaattgcactctatctcagcacactgtgtagaattttttttttttttttgagacggattctcactgtgtcgcccaggctggagtgcagtggcacgatctcggctcactgccagctctgcctcccaggttcacgccattctcgtgcctcagcctcccaagtagctgggactacaggcgcccacccccacgctcggctaatttttttttgcatttttagtagagacggggtttcaggatggtcttgatctcctgaccttgtgatccgcccgcctcggcctcccaaggtgctgggattacaggcatgagccaccgcgcccagcccacgctgtgtagatttttaataatacttttgttatctaaacgtacttttggttttggttatttgaacttcatgtcaccctcatgggaacataaacttcacgatcagaacactcacgtatactcatagtctttgacacgtctggcccatattaggtgctctgtaacaatttattgaatggatggaagaatgaattaatgaaaggaccacatgaccaggtctccttttgcagtgcattggaatcatcctatctcagagttgattcataaattgccccaactagaaggtccctttgcgatttttgaaagagatagtgatcatctcttccagctcattctttttgcaaaggatactagaaagggaaaattttatattcaagctaaggcccaataattaggccttttactataccttattgtctcacagaggaacttagcaaattcttgttattcaagtaactactgagcaaattagtaagcagcagaccaaggaaaaacagaggtcgtcaatggggcatagtgaaagggacatgggctttggtgtctgccaggcccgatttcatatactaactccagacgttcttagcagctctataccatggaacaattaatctctagaagtttccgtttttcctccttaaaatgggaggtccaacctgttataagaattagaattttctctgtcaaacatctaagagctcctggtgttgagtgtgtacctttaactgataatcaatatcattgtgtttgtattccttttgctacctccccgcgccatcaactccactaccatttatccaagagcaatgtctccaagtgcttaactgtgtgtctcactgtgtagttccctgaaaacataccaaatcccagcagtgtttttgtagcagcactgaagtctgagaaattagtcactctcctcctagaaaaagtaaatcattactgtatatctacttcttatatttatgttgtttactattgtgcatgtattatagaacccacaaatcaatgctctcagcagacaaaactgttcaaatctgcagcacgtcttgttgtgtactaggtatttgacaaaacagtatatatctgtcctgaattctgttttctgaaggatggtggtgtgagcactggagtctgtgattgatttctgagtaacttgtactttatcaaggaatagatgtgatttctcatgtatctgattaaccctccctgtaagattaccatcatttctataatgccagtggattattctgtgcttggaaagatgtatatcagatcattttaatcaatagcctacaaaaggtgtcacctggctctgcctgtggttatctataatatctcacccaaagggtgttgtcatttttcaaataacctgtttaacttaaagcacctaggaaatgaagttgcctttattttgaaacagtatgcagaacaatatgttaggtgaataaaatgtatgcttgttttctgcacgttaccctattaaaaagagagaataccagtgtggtaaaatatccacttatccatctccatcacacaagactggcttggtaacccatagattggtatgggagcaagataaaagtagggtatgcaatagattctgtgctggcatagcaaaatgggagcaatgaggaagtgacactgggctatcatataatcttttatcccaattagaataaatggggtgctgcagataggctggaacaacagagataaacccaagaccatcctgggcaagcaaggacacatgtcaacaataaagtcataccctgttttgtaatttaggaaactttctcatgatgttgagtaactgggacatttgggattaatgatgtatctgtgatgtactcctctgttggattccctgagaaaaatcttttgagatataaactaatcattgcttactattcagccatgtagagaatgtgtgtttccatacttaagataatgagtcctactaagagagaagaggtattaattcttgggagggataattttatatcaagtttagacagttttcagtctgcactaagctccttttttatggccagtttaggaaaaatgctaatgcctcgtatccagacctgtttggagatagagcaagtcaagcagaaaaacgccattctcctaaatgagcgttaggccacagaacacgaaatctgtcaggcagcattttacctggcatggatccgccaaagaaaacaaacaaatcagagttggattttttaagactaaataacagcaagccaaagaaagagcatttacactgaaaaaactgtaaaggttgacaacatcctcaactcattaaatatgatggggaagagtaaaatatgtagcacttttgctccttagtgtgggcttttaagcctctccttcaatcgtgatttcactacttcgtctctaagctatagattctgcctttgcaaaaagagaatacccacctccctaagtcgttccgtgtctaagaaaggtaacattatgcagagcattaaacatgtaacctgacacagagacactctacataataataggtcatttcccttctcaaacgacccagatttctagaggcaactagctatagcttgatgcaaaagtgttgcagtttttaccattacttttaatgcaatttaaaacgcaactacttttgcaccaacctaatataataggaatagacaacagcagtagcaggcattcgggtttcccattgtcctcggcattctagggcaaaccaccaagatctaataagctgtgagattccaaaagaagggcgccaaaccttgggctgcacggcttcaaacttcgtcattacagaatcaccagcgtctttcttggtatgatctgcgggctagaggacaagcctggtgttattagcacagtgagcaagtggcaagagcaccacctccggagccacaattagggaagtaccatgccttgccctggcatgactggagagtaggggccaatgttagactataagagttgactaggattgattgccataaacagtgggccatggttactttcctcggagcattgcagagagcctctttctctgggaggccagcctacaggagatcagtcttagacaagttaacctttacctttcaattatcatggcttaaattttcaggaactctcttctagtatctgaatgttccttatttgtagcacccttttcttgtttatgcaaataaacaagaaacacccttttcttgctactgtcaattcaatatctaatatttctctgaaaataataatgacagaatttcttttttttttgagatggagtcttgctctgtcgcccaggctggagtgcagtggcgcgatctcagctcactgcaagctccgccccccgggttcccgccattctcctgcctcagcttcccgagtagctgggactacaggcgcccgccaccacgcccggctaattttttgtatttttagtagagacggggtttcaccgtgttagccaggatggtctcgatctcctgacctcgtgatctgccctcctcggcctcccatagtgctgggattacaggcgtgagccaccgcgcccggccagcatttctttttgcttgccttgaaattgatcttttgtgttagttgtcctcacatgtctattgactcacagttgttggcccatatttaagagtgtggcacgaaaaagcctatgtgaagccgtgaacatgtagatgaagttcattgactaagaactgggccatttccttgtggaactccccatacccacattaatatttcggtgtttccttttcggctgatcgctacctagagaaagaatatctagtacctagtctcatttggaagaacacagaactcaacagcagtgtcctgggagcctccttggggaaggagactgagaatctcagcttcactgtatgaacactcactaaatccctgctatcctcagttcaacctggtgtcctctggcccagagacctacctctgtattacctgctcagaaagtaaaatcccagaatacttctgggatggggagggttagtcacctggatgcatggaataagggagagcaaatagggacctaattgattttaaacagcatcttccagtgctctgttacctgacttcaagtaatacccgaattcccaaatctttgggcatttttctatagagtaagtcagactgtttcttgtctttccccactgccagtttaggattcagggtttcttatctgctaatcatccagttgctttccagtattttaacagtaatacctcccaaccattctctctgtctttataggcttatgccattaaaaaaaaaaaaaaaaaatccttgtactactgtttaaaaaagttttagaaggttcctaggactctaaaaggatcattgtgacgaagaaatggataatttaaggaagccagcacaatgcctgacacataattgtagtgattatttttgttattttgttaatattcaatccttgtaaaatcatccaagtttataaattatgtactatatagccaaacagcatggacgaggagggcgctgtgaaattaagacctacgtcgttcaccttcccagtggtgtcaggtcatctctacaaccatgagcttttagtatggttagttcccattccatttcatttagaataaccttgtaaaagaaacagggattgggtgtgagtgacacctaaccactaacatgataagcattctaaatctatgttcagcatcatgtaagtacaccctcattgaaatgcagatctccactactggtaattccacacactcctattgaagaaagaattgctcctctgaagtttgctaccccatcctctcacgtttatcacttctgcaaagtcatgcagcatgcctcaggtgaccctgtgaggtaagcaatcttgcactgtatgtgggcatttgcgctgatcttcccagaagcaacccttagtccttgcataatttctagcctcaggagaattataagatagaagacaagtgggggaagaaaaggtttaaaaagattctgtgttctttaaagccagatacttctcagctaagcttttctcagacctttcatgtccctcaataaagtatatttttggctatgccccataaactactccaataatccattaagatagctgtagaaatcagcatagcaaactatcagtgagctggtttagttattcaccggttattaatcttctcagctcagggtcatattgtcctgtcttcagcatttttcacagtgtctgatgatgttcagagagttaatggaggtcctgaaatgtggatacaacaagcatgataatcccttgacttgatgtcattctagggatcgttttcaaactttgtgtgttgccctggcaaatgagcaagaaggcacctgtgtcacttatctggatgtttgtacactgttctggcaaataaatgtctatgtacaatgataatttccttatgatactttcactagcaacaacttgttttgagcatttgttaccagttttagtagctgtcatttttgtttcttctttagcttccttgtaaagtcgaggcacattttgtcctgacttagagtcgcgatatttctttggagattcatgtgagcgtcttcctctcactaaattttcctctccccgccccagtctctgcatgtttggagaagttatcttcctctgaagcttcctgcacttaaaacagacccaggcacaagagacttccatgatgatgatggtgatgatgacagtgatgatgaggatgaggatgaggatggtaatgatatctttattcaaacactgaaaccattcatcatgttatatgcaaccacaggaatattacaagttaagaaacaaattaactgacttacaagtcaaataactttcccacaatcagtcaactagtaaggggcagagctaaaatttgcatccagatttttctgacttcaaaactcagtttcttagctacttccagtctgtaagagcagctttctgtctagaatctgtacaccctcaccacaagaatctagatagctggttttcctttggatctgcatggtacaggcatctatctttacacctggaagaggttcttttacttaggatgtctgtattcaacaaaatatcagttgagatcacgtagggcattcttgacctttgcaaggattttggcatttactctgaggtaaacgtggaggcatctttgtttctgtcacattcttagtaatagctagcattttttgagcactttttatgtagcaagctctattcttgtttgtttgatcggtttggttttttgtttttgtttttgtttttgagacacagtctcacactgttgcccgggctggagtgcaatggcgtgatctcggctcactgcaacctctgtctcctgggttcatgcagttctcctgcctcaacctcccaagtagctgggattacagatgcacaccaccacacccagctaattttttgtatttttagtagagacagggtttcactatgttggccagacttctattctcaaaactttgcattggctgggcgccgtggctcacgcctgtaatcccagcactttgggaggcggaggcgggcagatcacctgaggtcaggagtttgagatcagcctggccaatatggtaaaaccccatctctactaaaaatacaaaattagccaggcatggtggtgcatgcctgtaatcccagctactcaggaagctgaggcgagagaattgcttgaaactgggaggcagaagttgctgtgagccgagactgtgccgttgcactccagcccgggcaacaagagcgaaattccatctaaaaaataaaaaaataaaaaaaaccctttgtattaattcaccttagaacatcaccctcttcttactctcgaaataagtgtctctttttcctttcttccccgtgcaaatctttggcatcaatagtaatggtaataatagtatctcatactctgtagctctttatgttttatgaagcatgttaaaatccattaactcattttgaatttcatagtcatcctgggatgccaaataccatctcctccaaattatagataagaaaactacagctcagagacgtcgaatgacttgctggtggtttcatgcctaatcagtgctgtatggccaaacctagaaactaggcttttagacactaaattgagtgttttatatatttcatcatgatgacatgtttagcaaaagctaggttagtatcagagagtcagtaagagaaagtcctttactccctgagaagacatccagcaactatttctgagatgagctctagacctgggctgatttccagtgaacggagtcctgcttattactggtgctccagcattgtttgggagctcctgccatgggaaaatagcagggtatcctattgaccgccagggtgcccaagtgaacattgcatcctgcatgaaaagtgccctccgggattgtaaaaagtgtcaggtcctgttatggtaactaaatgcaagataacctttctgtggaaagcaagcatatgatggataagaaatgattttgtaaactatggaatgatctacaaatgcaaaataccatatgccttgtacatcttgcctgcttgagtaaatgaatgatttttcttatgtatctctctgtgaatattggtttattcgatgctgcagcagtttgcaaactctgttcactcttgcactgcagcccagagacacaccctagggagttggcatgtgtcatacaaataatgtgtacctatttgttataacctaggcttgggtcttgcctcactatctttcctaccaatactgagctattagattctaatggataatctaggaagtgaatacattcctgtaaactttaacaaattttattgaggaacagacatttaaatgtacacacacacacacacacacacacacacacacacacacacccctaggggttttgtttgttttaattcaagaaactaacacgtttgtggaatgaggaagtcattaatgttttttgactaaccaagacctagccaaaaatctatttctctttctgcccttaatctctttctgaagtatcctgccaatttttaatgctgaccgtttctcaatactttcagtctgtagtagtactagagtgcttcacttatcactgtggcaaaacctacttgtcattttagagaacagtaaatgtggatttggaaaatgtgggactttgggtcacgtcagaactctgacttaaatttcaggcaccctttagttggaagtggcaagatacagcttatctgcaaatgactgtaattacaaagatagagcttgcccaacaaagggtttctattttaatatcataaaaaccaaaaggtggaatggtgctccacaaaagactgccttttcactttctaaaaattcttttctggctctgtgtactccacttggtgtgaatgtcatttattagcatgtgatgtctttgtggagtagaggattctgccgctctctgcttgtctgtcttgctctgtttctctgcattttcatctccttttccttgtctcttggctttaacattctttccacctccattaccctttatattagattagatctaacttttaaattatttgatgtatctttaaattttgtgttccctgtacctaatttaaaagacatgaaaagttgtaaacatctctctgaaaataaactaaattaagttgctttatacttgcgtgaccctcgattggttttttttttttttttttctctttgggtcagcaactctcaatagaaaagtttccttatctctagtgtggaagattggactaaatgtccagtgaccttcaaacctgctccagagagtagttcttccttacaagagtgagttttccaatgatttgcctctttctctccaaaatgaaaaacagtaacaaagtcttaattcagggctcttcagattttcattctccctcctttaaatttcactgaatgtgtatataggtctcactatgaagcaagcaatgcagcaggaagaagagtctcttttagttaaactcataatgccttacctagctgcacacaaagggggcatttcaacaattgcaggggacctaatatctattaatagttgcccattctgaagggtttcaggaaaaagttcacttagaattacagacaagtcctcaaacaagctagtcagtggtggaccagactgttgggggtgggggagggaggattgtttaaggttttgttttgcagaaagcttcatcaatcaatcctatctacatcaaataaagagagggtagctaatattgtctaccaagatattaataccttctattttaagcttcatatgctcctcggtgacctcatctcaaatctataagcaaacaaagaagtactgctttagaatatgcgaattattgcttctttcccaagatgcagtccttaaacagaggaatctgaaaacatgtagaaaattgctgacaggagcaggttaaacagaaaaagagggacactctccttctgctgaggtttcagcaccatctactgtccagaatattaatccttccccacattgcactgtgtgtgaatggcacttggtttttcttttgcatgtaatcacaatggaaggcattgtctttggaattcattgtccttgcctcaaggtgtacatttcctttcttttatagtttaagtaaatattcgcttactttttatcagtagatgcagcccgatgcccagcagatgcaatcacacattcctttaatcagcaaagatcttattatgccattcttacacattgactatgatgaaatttactgtatttcactgatactaatgggattttggggggactcttttgctcagtgagtcataagggagagttacttatgtgcagtcactgaaataaacagaaaacattctaattattatttgatgaaaatgtttctccgtgggtaaaagatatctgtggttcccatttatgattcttttttatcttccatcacagtcaaaggcacgccatagagtgattttaattataccttgactcgaagatacaatgtatttaatttgtcattgacagtagtcttttcctagtcctttcagattgtcatttcttttgaatcgtaaagaaagcttcaaaaagaaaatgtgagagggcaaatttaacatataccccccttccctcttctgttattacttgctattttgcttgaggaagtattcttattcatagtgggaagcttaggcacctgcagaaaattctttgcatttagaaagacttcccagatgagaaaccctgctactgaagcatggcacaaatccagaccccggaggtttgctttccctggtcatgggtaaaaataaaaacaaacaagttgacggtgaatgactttaagacagattatatcttgcttattaaaaacaaagaaacaaaaacctccttattaatcgttgtgaccaagttagagacttgggaggcaaccaagagcattcgagcatcattagaaccgtcttcataattaaataggtgctttatgctacacattttgaccaggcagatctaataactttgattaccacctgactgattgtttcccaagtacctatacttggccaccctcaattggcttgtgcatagtagtttccatttgtggcagtcaagcttattaaacagctctgctttgcgattttcccccagtccttgaaaatagatcagtaagcattccactcaggggcgatttgtaaattgctttacacaaggctccagtttgtgctcacgccgactggggtcaaaatttgccttgtgttttcttctgatgtcatttgtcaagttgcacacgttgttccgagaaccaggtcacaatactatgtggctgtgcctctcggtatgaatcgatgaaaaaccttgacttgtgaacgtgccctatgctacttctgtgttttcttctgccacctaaaagggcagacttccttgtcttcagccaaaatacacttattgttctttttccaattggttcctcttcccttcttcttaaagcaaagtcacattttaattatgttaacaaaaagagaggtaagataaataggggtgctattgagagaactagcctatgttttaaaactgtaaaaattctcaattcacagacataattcctcaatggaaaacaaatcttagagaaaagtaaatgtgtctaaaagagatcaaatgtgtaaaggattttccaaagagcaaaattataagcaaagtagacacttaggaacaaactacatatatagatgtctgatattatgtgagtgatgataacctgaacagattttatttcatcaggatatttcggcagttaaagcttacccctaaaatcaggacttggagctgagctcccttccaggaacctggggcagacaaaaaaaattctacccagatttgagacctttaaaggacatttacctgtggccagaatgggcagcaaggccaccccccaaaaagagtcagacctgtacagtattgggtgcaatgtcctttattttgctatgccgtgaagtgcaaactgcacatttttcacataacctgatacaggcctttacagccacacaacagggagaagtgggtgctcacgaggaagaaaaaacttcgcttataagatgaactcccaaaccaaaattacaaagaccttgaggaagtctgccaccataagagacaatcagcaaatagaacaaatggcaccttcaaaagtagcaataacggaaccacctgaaaaggacttttagctaagtatatgtagatttctcaaggataacctcaccaaccccatccatcatttcctacttccctccttaccttcctaacagaatggatttgtttctgaaaagtaactcaggaggaacagaacaaactggaaactgtggtgtttccatttgtttgttttgatagctccttcaaaatgtagatcctaatgacccagcggagaatagtaattataaaattaatgtttctcccatttaaggatgaattattctctaaaaactaaatataattttaagtaatgtcttgctcctgacaataggtattttatgaaagtattaattcaggttttctccctggtgtgaaatgcagaaactcaatgtttaaattttagggaactgatacattttctttattcattcttctttttataagtagcataaaactttaatttttaaatggcatatgctctagaattagtattcgccatcttttttattttattgttctgtggagtattcattttaaatatttacattttaagtactaaagcaatctgagcaaccctccctttcctgtctggcacagaagagtaatcacagtgagtgaggatgcagaatggtgaggtaggttggagagctctatggagacatggctgtgggtgggtatagaggtggtgggcagaggagacagctggcaatgttggcagattggttatactgaacaaaatgtaagttgattaagcaaattaggaaatgttttcaggataagatacagaaatacttatagatgtgtaggtattatacatgtatacacacatagatatttcccagctctgttgctgagaaggcctaggatcaatgaccctcagtaacaatgagcacattgggtctccacctcttagttctcaaagccatcctccactaaaaagaaccagagctccctgacaaaatgactgattctgggactattgcaggaaaaaaagtataatgtgaaccttactggaccagaaagtaaagaaacacttaatgaataatagtaaaatgtaaaacatacgaagagcccaacttaaaaggactcccagtggccaaaatggggacaatttgagcatcagtgtaaataatgatagtaatgtattaccacctgtcaaaagaagccatgaatttatcctaatgtaagtaagtatataaataaatgggggagaggggaacactcttccttagagtagaatgtcagctgatatatgtagaaggaaagatagcaatggagaatcaccgtttgacaaccatcataaaagccactaattcaggaaggagtctttaatggattctaaggctggtgggtacaagtttgatgaccatcaggtactggtgtaatctttgaatacctccccacaaagtactcattatttatttatttattttagtttattattctttttcagacagagtctcactctgttgcccaggctggagtgcattggtgcgacactgcaacctccacctcctgagttcaagcacttctcttgcctcagcctcccgagtagctgggactacaggtgtaccacactcaactagtttttgtattttttttagtaaaggcaggatttgaccatgttggccaggctggtctggaactcctggcctcaagtgatctgcctgcctcagcctcccaaagtgctaggattacaggcatgagccatggtagccagccaaaatactcataagttacaagggtgtaaatggtaagaataagatggagaagccaggcaaacaccaccatatatatatatgtgtatatatgtatatgtgtgtgtctgtgtgtgtgtgtaggtgtatttgtgtgtatatggtagggagaaggggtgtgtgtgtgtgtacacaaatatatatatatatatatatatatatatatatacacatgcatatatatatacatatatatatttacacacatatattgtatatgggggagaagaaaataagcaaatacagtaaaatattagctactgaggagtgtatatgaaggtgaaagagttctttgtacttttctggcaaactttctgtaagtttgaaattatttcaaaataaattactttttaaaatcaagaaaaaagtacaaaatgtggccttataagaaaattcagcaataaacacagatgaagggccagtgcttgcatggtgagtgctgagttagccttcaggcagttcctttttaaaattccatattcgacataagtctggataaataataagaaatacttaatatagcttcctgatttatagtacttcaagattcaaggccttattttcatcagtctcccacagggccactcacagattgtccataagttatctttaaccaactctcatgagtaggaacagaactaggcaccagggacttataaaagtgtaagatctagtccgtgactcccagaaagctgatcagttacagggggagaagcagggcacgtgtaaaaaagacaaatgattttgcacaacaatgcactagcttaatgtcgaagaaagaaaaacagttaattccgatgagcttcatgaaaggataggatcaccagcgaacagggtggccaggaagggcatgtggggaggtggctcggattcataggctcttcaagacagtaggctttttccagcctggctggccactagcagaacttggcatcccctctctgagggcgcccacctccacctgaatacctccagaaatggagattcatgttcttctgtggcagcctatttccctgttggaaaggtcaaattagtagaaagttcttccttctacagagccagaatatgcctgtttgtagttactctttgctttctactttggggcaatgcaaaataaccttagcttatcttctgcctataagcccttcacatatttgaggactgttgtcatgtctctcctaatttacctttctcgtgccaaacactttcagttattttagctgctatggaattattagatctttcactaacccaggtatactaatgtattaatgaatccaaaacacgttcctagtaagctgtagtctgactaatgcaaaatacaaccagattattacctccctaaattggaacatcatgtgttatttatgcaacctaagatttcattccctttctttggcagctgcacagactccatgagcactgaaatgcttaggtattatccatgtgagctgccaatcccccagcatgtacttagtagctgattttttaagtgtagttttttgcctttatccctattaaagtttgcctaggtgaaaaggttggtcccacttgaaatcactatgaattttgattctcatctaatgtttagggtatgccttttagatgtgtgttttatgcagaattgatacagtttatcttgcactgatttttattgaaaaaatggtgccaactatagaatgttgaaattcatccgtagagatgctacctcaggattattgtcatcattaatcaacactctttgctgtggcatttaaatatgattaaaaataattctctgaccagtccccttatgtcatctgaggtttgcttgctgtctgctctttgaccagctccaggcctttgaagaatcccacttttaaattgtccctataaaaactaatttaaggaaaaaagatacaactctactgaaaggcatcatcaaaaccattagagtcaagaaatttgttaacaaaagggatgtgtctccttccacaaatgaagatggctgaaacacacattaaatactatcctgataggcaccaagtgaatatcttggcactgtaaatgaaagataaattatacactaaaatggaaggattggtagggtatcaggaaagcaacattgaaatggaattcgtatcctgtggacccaaaagcacttatttttgcagataataagaactatcagccaggtatggcggctcacgcctgtaatcccagcactttgggaggccaaggcgggaggatctcttgaggccaggagtctgagactgacctgagcagtatagcaagaccctgtgtctataaaacaaagaaataaataaaacattagccaggcaccagtggctcatgcctgtaatcctagcactttgggaggctgaggcaggcagattgcctgaactcaggagctcgagaccagccggagcaacatggcaaaaaccctgcctctaccaagaattcaaaaaaaaaaaaaaaaaaaagaattagttgggcatggtggtgtgcacctttggtctcagctactcaggaggttgaagtgggaggatcgtttgaacctgagatagggaggttgcagtgagccaagattgtgcctctgcactccaacctcagggacagaatgagaccccatctcaaaaataaaataaaaataaaatactagctggacatggtgttgcatgcctctagtcctaccttgatgggaggattgcttgagcgcaagaatttgaagttatggtgagctttgatcatgctgctgcactccagcttgggcaacagaacaagaccctgtcaaaaaatacaaaatataaaacagcgtagtgttttaaaaaatagaatccttatccaatggaccccaaaacacttcattttagagacaataaaagctataaatcagaaagtctttccaccagcagtgaaagtgagaatgtaataaggcttggataagtgttgtatttatacatctaattgtggatctgattattaattgagtagttaatattattaaaaataatggttaataattaactcttcctcatggttataatccttagaacaaagcagttagtttgccttttgtcatttatacgttatagaaaacactgtagaaagtaaaagaattttttttttaactctaggagaattaagcacttggtaaatatatagatttttaagcatcagtcctctggagttcagaatttatcattctacacagtatgaaccaaccacaagtaggaaagtttagggatgttgttggtcctatttattgttgctatttaattacatccaaatccagccgtcagttcacatcttcagttctaattgcctttgagagttctatgcacggaacaatagctgaagtgactcttcagaacagaagtcataaatataggttcttcctgatctcgatgaattaaaaccaaaggagaggagacagtttgttttgcaggaagccatctgtttgtttgtatacagggtttgtattcaaattttaggaaattaatcaagtaaaaaacatcaaaattcacaacacagaaaacaagagtactgaacaaacatacactttgagaaaaccaagtcgctaatgagattttgaacctctttagtttaatcttttcttgtccctaggagacctctctggtatgtgtacagtgcatgacgttgcattgattcttgctgctttaaggctcagaacatgaatcggcgacaagtgctgagttaatgaatcagcagctgtcagcacaacaactgcaccaacataatccttgactcagggaacttctctggtccttgcttaaaagacagctaagtttaccaataataaaaatctgtcccagatccctacatgtgcataaagaggtgaacgtttctttaggaaagaaatgtcattcagaaacgtgagccagaatttcaaatggctctaggctttggggtatgtgccaactccttgctgctagcccaaaagttgtcaggagataggaagacaagacagttttagggactggagcctgggcatttgactccacactcataagtctgatgtgtaggcttagagctagagccaccattttaggcataaaatcatcactgcttgttacctgtctaaggcagtaactacctgacacgtgcagtgaagccctctgcaaccatctgcaccccatggcagaaattctctgaattcctcctgcgtttgaatatcttcagttgactacacataggagtgtaaattgctgtattatgcccttagacttattcctgcatgatttgcatgtggacatcgtgttttcagtgaaaagaaaggcagaatcgcacaacagacaatatcttaatgactcttagacatcagtctgctcatttgttaaatagggatgataatagtacctatttgttaggaataaatgaaataatccatgtaaagtgcttaacagtgctaagggactcagttattatgaatgttcttattccttcagcctctgttatatgtgttatccatgtaaacacaatccatgcttggcggataaatcaagaaataaatgaattaaaatgaaaatctaaattgcagaatcagtgggcagctgtttaaagtagaactaggcaacatctttatcaaataaaacccatagaggtatatcattttagcctgggatctgtttcagtcttcattttttcttgaggaaaatgtaaatttaaaaacgtcaaatgacatgttaagtcaaaatggggctattccttgatgtttgcttagagtaagatttgtacttacctcttttcctcattaaaaaaaaaaaaaaaaaaaaaaaacaacttcatcactatctattcctgatggtaagtgaatcaatatagcggatttttattatgtagtcctcaaaagcctcggtctttcaaatcaggggttttctatcccattacctctttgctggcagtacctgttgttcacttctcatttcatggacatcactcatttaacagtgactaaaagcacattaatctacttatcatgatcttttcctatttttagaaaacaacaaaagtatatcccactactagattataacctatttagaacagagatttcccttttgtaactgagagattttctttctgtagttggataaaaggatagaaaaaatgttttaaatactctctttaaagaggaaattttagcatgggttatcagcaagtaagactcacaaaaattctcctgtcagatataattacaaaattcccagcggatattttaatcccagaggttccctgaataaatatttatgtacctcacagcctgaaatgcaatcccgcgactatgggagaggattagtcagtgttcttttattatttggtttggttttggtttgtcttctttgtaattgtttgattggctcggtttggtttagtatgtagaaatttctggaatatggcctaattcagaattttattctttaggcatgtatgcggcctttacattgaattcaaactgcttctcactagtgtactctctgacaccatttatgaaatcatgttgcagaaaaataaggcactatgggtgtgaatgtagttttggagttcataaactgtctcagctaagcaagcccattctattcccagtttaaactataatgtaaagggtgaattttaaagcgaattgatggtccttatttttaaaaagtaatatacctgtatcattttgtcagtgatgttcattacagcattatttattatttctaattataaatattagaaaaatgtctaataaaatttgctaaaatgccaactagtttcaaaatggttaaaactgtaagcttaaagcagattataaaattatgttgacaaaggaataaacatgcctatacaatattgaggagaaaaaggaaaatcgtatttgtctcatttttataatggtgtaaaacaaaacaactgaaaaactgtgaaccaaaaagactgggggaaattataccaccatgaaaatagatgttttatctgggtaggatttgtttttctattccttcttttaattttcctgaatttcctaaattacctgtgctaaaacatttattacttttacaatagaaaaaaagagcctaacaaacttcaaatcaacatggatttttcctgtttgcactcagctgaaatgtagctttctagtgaaactggagagagacgaaaaccttttcaaagaggcaattcagagcaggctgccagaaagtaagcccttccacgagcatctttagagatctcacctccatgctccctggctgagttctgttgctctgagaaggttcacataatgagtgttttcatcttttcatattaaaaatgacctcctggcctgagtctgagcttcccagatgactgaggtttgctggtcacagcctcagaaaaaataaagcaaaattacttagtatttcatcctgctcttggagtctacattgtatttccacacaagctcacagactttgttgttgttattgtttgttttgttttaactctccagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggaggggtaagtattaatagcaaaaactgactcaaactaacttgtttagaccaacttaacaatatatttaaagttactattttagaattttgttcaagtaatcttatggcaagaaactcttggttaattcctgctcctttttgcacaataaatgtggcatcactcattgaacaactctatatggcaggactgctccctaactggcaccaatcctacaggttaattattcattcctgtgtatggattagaaactaaggctcacaggcattggatgacttgccttggcctcatagctactgaattgtggaactcagcttaaaacttcaaatcccaaactctgtgtcacatatcatatcatatatcctagaatctgaccaagaaaatagcttaaggatagtttccttctgtttttaggctgctaattaaactccctttgaccttgtagaaggcacgtcattgtgaatttagggttttctttcttgaatttgaaagtctgatggggttatttactatctccaggtaatttgaattcaaaatgattggattttcaaaatgccttcctttccataacggtatattatcattgaacacataacaagaagaggttaaatctgggaacaattcctatcaatcacaatcattgtcaaaaaatttttttctgctctaacgcacctctgtgatcccattgacaataaagatggactccggctgccatttttatgatggagtccagccaaaacatagcggaatacaaaaatggggccctgacttgaaaagctctccccacttcctaggctgctataaaaatctgtccaccccctttacgttgagaataagtggcctaaagtcatccatgtgatatagtgagagcatattttccacccaactacagtactagccctgttcatcacagtcttactacctttatcaaacagggtttttgcagttgagtcacagaatgcccaaaacaatttcaatgactgttgtctcagttctatgccaagagtggtatctgattggtacaactttagatggcacaggaaagaagttaattcgttacatcagtggatgcctgggttcactagggattatctcttgggaccctgactgagaaaggctggatgaaattgccagcgtaaaccattctggacctctttcacatggttcagcttaataactttggctaagtgaaagaaatattaactacttcacaaagacattggagatattgaatatcctgaggtctaggaaagtacatagcccaatgtctaccacaaaagaagtacttgataaactttaatggtggtattaattgaaggaagggtaacattgattgtaataacaggaaagtgtaaatcgagaacattcttcataaattaagcagaatgttctcacattaaaaccaatttcttgggcaggagagatattaaaaatgctaaatctcagaatggcgcaagcaccaaccaatgaaaacagatgcccgaccaatcgaagtggacgtcctaccattcagacacatgtagcctttatgccagaatggtgccagggctaaggcagaaacagggacacctaatgaagtcaaacactgatgactaccttttgtaaagacagctgtccgtagagctgctcacattcatctttcatatggaaaatgtctatctcccctgttaaactagtgctaacaccaatcaacttctgctgagaaatacatagaaaattaaggacagcacaaccacatgtgagatctaagtgtactagccactaggatcattaatgtctgtggagtcaggacttgacaatagaagagataagcaagcgcaattttgaagtcaagcctatttcagcttcgacttcctgggtcagcatggtggaaatgatgcttggtatagagttaacctattgaggttttataaaagttattatttcattgtcctctgatacaccccatccccaccgagtattctgtcaggaacacaacagactgcggtggtggaaaataagcagatgctgttgttttctttggtaggaacataaaaaatgtagatcttagttaatagttgggtctgggtgacttcaaagggaaagagaaagttattgtggtctgctttgatgagactcttacctcactcctcactctatttttttctttgtttcagttttactttaaaaacacaaatccagtcaaaatgtgtaaataactacagtacttctgaatcgcaaaatcaaaattttctattaataggttgctgtgctctgaaatatccaggctgcaagtttctttgacatttaagcccttcatgaataaagtgaattagatagatggtataggcatttccctaaggccaatgtggcttcccaccttccctgcacgcatcccctggggcatattttttatttaaacctgtattcgaagtccccatatgtgaaatttcttaggtaaagtatcaataatcttaataatgatgatgataatagtgataattcctgatacttgcaaagtgcctaatcatttatcgggtactttcttatatacacttgacccttgaacaacacaggtttgagctgtatgggtctacttatatgtggattttttttctaccacactcagattgcaaatacaatattcgtgggatgtgaaataacccacatatatggaagactgacttgtcatatactcgggttccagagggctgactgcaggacttgagtatgtgtggattttagtgtactacggtcctgagtcctgagtccaatcccctgtgtctaccaaaggatgactgtaatagctccttaatcctcacagaaatcttgtcaaataggttaacaattattttcccattttattgagcaattataagacttgatccgtaaacagtggcatctggatgagaagccaagtgttacaaacaaaagacgttttgggttaaaataccatagcttttcctgaattagatttaacatcttggacatgtctgtttcacaaaaaaatggatcatggctgtcagtaataccagtttagagttaatctacgcttcaaggtttcagaagattttcacataacacagataatctcatttgattttcacaacctagcatgaaggtcaataaaggtcttttgaaagtcagtaaatcaaggccaagagagattaagagatttagatgaaatcacacagcaggaatcagcccaagacaactaagcaccaaaactgtagctcttccttcactccatgctttggcatctcttctaatcgtatttctaattggcaattctatctcttccattatcctgtgaatgtgacactctgtactgaaacgatggagataaccaaatacatattaattttgaaatagaatgaggatatggtctttccggatgctagtctagtgttactgttaagaacagggactatatgggttcaaatcctggctctgccattttctagctacgtgactttaggcaagactcctaacctctttgtgctggaatttcctcatctgtaaaataaggataacaagaatacctgcctcagaggacatgtgagtatttagtgagtttaatataggtaaagtacttggaagctgcctgtcatatagtaaataccattaaacatcatccattactattgtcattggagaaatagcaacacaagagtctgtgtcaatttcctgttgtatagtttggaatgggaaaatgaaggagggccaatataccctaaattatcttgtcatccattacgggtttagaatgaagtgtactttttcaaatctggcctctagggtggtctcttcatcaagcagctattctccaaactttggattaacagggctatgaaccaaactccaaggtgtagcagtgttcttcaggtaaagtgctgcctttgtgatagcctgtggaatcatctcctcacatttattaaaagtactgtgctggcgaatgctggagaaatatttctggggcgcatagacatccaaaccaggatgtaattagtcccattcttctgctaatcaaacatgcatttggcatttggaaaccaaatgagcactgttccacactaggtgatgcgagatttccttggagaatctggtcttcctaatcctttcattccaacctgggagcaataacaatgctggctctaagaaagggttgagcaataaaatgcagatacttccaaatgtgggcttgcttccgttttccaaatacagagttctaaagtatccgaacgccaaccaaggccataggctgagggcatttctgaagaaactcacaaaactagatcgagagccaccgtagtacgtaggacttatgtagcatgtaacttacgtccttccgacatgggtgccaaactgctccagagactcagagaagccagacacctgaggtcttgtcgaagatgtgttctgaaaacgtcggtgttcccatctctcaggcaggctcacatatttttaacaggccatggtttgcatcactaatgctttcatcagccagtgtaaaataaatccattagtcaccgtgtccttcatgtgataatgatatttagagctcattaaaaagtaattgcagccactttcccctactttatcagcaggattcagctggtgatttgatgatccgaaacatccaactgaagcatgctgggaaatatgtctgcatggtccaaacaagtgtggacaggctatctgctgctgcagacctgattgtaagaggtactggattttgttgttattgttgttcttgaaatattttcatgatatctactgtagcgcagagttccagaaacctcagtggtttagaattatgggaaaaagtcaggcagaagctgaacattgtaaacagtggctaacagtccacagaagtttctggttcatatacagttcctcagtgcggcttgtcagaaaatgcaccgaacacatccagtaactttacactagaaggataattgagtaaatcgagtacccgattacggctgttggagttgatatgaccttctagaacaaatttaggtgaacaaaagcagatagtttaaagagggattaaactgtccctttttatgtttcatctgggccaaactgaattagtatcctaggccactggtataacagcagcttaagtaaagtcatcatcaggtttatccgagtttccttttttccctaaacttcacagtgctgttcggttcctaaaatagggttttgggagaggacacttcctgactgcctgggatgtagtaaatgagctgagagttgatgtaaatactaacatttttgagattctcttgaatattatcagcatgacctaatttggacctaagagctatgacccccccggctgagcaacaccaactgagtacattccaagcctcaccaaaccggttggcaaaggaactgtaaatggacttttaagaaatatttttaaatgaaaattaaaatcttcactaaccagtgtacataccagaatccaacctatgcatgctcaggggttttctatagcattaaaatagaggccaatccagacatcaaaataatatcttagctagaatctccttcatcagaatccctgactgttggtgttcaggcatctttggccggctggcagagcgcatggcaaaacttcgaacgcaagaaaataaaaatttagggtatgagcgttggaggcagggttaatctgcatgcacagagaacaaggtattattggaagccataaagagtgttgctgtatcctctaggcataatgtaaggggggaaatgtgtgggagttaccaacttaaactgattgtgaagagagggttcaagagaaatagcaattccaatgtgtctgctttgttcccctttcaattgcctttaaaaaaactttcagcaacagtgcagacaagggctggaaatgagaaaaaactttcaaccgaggtagatctgcccacagaataacttatagaaatgtgtttatttccatttgaaaatacaccaggctggtctgccctccccttgggaacaaaagaattctgttgctgaaaatttatcctctatttaattaggataatgttcagatcagcagttaaaacaccaataaattagactaataaatatttaaatcagcaatacttgaagttcttaaatgatattgtatacttcatttcacagaaaataacattaaataccaggaggaatttgcaaacgcagtctaaaagaaaatctagtctaatcagttaataaggccaataaattaatgtgccatttaaaaccataatctttcattttatctccttctgctctgcccttgcagcttttcttgcacattacagagggggaggcaggaatgtatttcaccaccctgaaagacattttcatatttgaaacgtatagcagctttgagtcttggctccagattctttgattttctgaggcctgttctatttaacctatagcactgtaatggcagccagaaaggccacccttcctgagggagaagcagaccccagaatcaaactaatcttccctttgccattgcctgaaacaaaatcttctacatgcccctgagtgtgttatcattttgttcagaggacaaacatttgtacatttttcattttgaaagagggagtccacttccctaaaacaaagttggtaaacattctgtaaggtcgtagctatgcatcggtaggagagggtggcaggaagataaaaaaaagaacaaacaaatccaggaaactaccatcttctctccagtgtccaaactcataccagcccttcattttcttcctatagagaggccaacaatggactcagatatttcctatcgatttaattctttgaagagttcagagggaaacacttttctatttgtggtacttagattttaaaggacatcagtgcagcatccattaaaaaaaatggtggggaatgctaggatgagaaaactagtgaaaaaaattatattgtcttctagactttatctggttaaaaggggtcccaagaccaaaggttacatcagctctatctaggtgacattagactgacatgctgaaatgtcaccatggaaaattaatcagttccagcatacagatttccagacatttcattcaggagtgggagggagaagataaatttagtctcacctgtgggtctataaaagtgatttttaaaaaaggaaagggaatttagggcatcacgtaaacggtgaaggagtgaatcctagaacaaaggctaacttcaggaaattgctgttaattttgcactgctctgtgagaggtttcttttttccctgtccctgtgacatggcctgatagtatttgggtagtacatttgattgctagactggggattagcaaatccttcctaggaacatctccttatgcccgtctaatgggcatgaggtttgtcattatgtcccctcaccatcaccttccctcctgaggtggtcaattgtaccttgttaaaaatgcatttaactgcctggtaagagattttcatgttggaaagtgggatagctgcgggtctttgctctggctctgttgatattttgtctttacctgccagctgctttccatccctctatttctttattagtttcaagccttcatttaaatctgatttcctcccctttccatggtttaagtacatggacagaaacaacgaacatcaggaagagaagtagaaaaatacgggtatgagttgcagaaactacagatgagggtctttagtatctagcctaattttgaaattgctttgaagaagggagcgccttgactcttgcgcaccggccattttcacagcagttcccttgcacgcaagtgtgtgctcacgtgggaagcagggttggatgtgaagagagtgctagtaattacagtgcagcagaatgtgcagagcaacactgtaaccttcaaagttttaaagccatttgtgcttaaatctatattctcagtggtagaaataaccatttccagcagactatactctttatgaaatcaggagcaatatctatcttttctcactaccgtatcctcaaataacactgtctgacccatattaggaacctataaataaataatgaattaatgaatgtgggctcttatggtaccccaatactctctattaacattaagtattcagttgtaattatttgtttacctattagtttttcatattaaactgtgggcccctagaaggaaggggctgtgtttcattcacctctgtggtttccaagcccaggaaagttccaagcacgtagtaggagttcaaaaaggatttgacaagtgatgaatctgtgaatgggtagataaatgaatgggtcaatgccccattcaagtatgtggctcctttacttgggtgtttgaatacactgctccaattctgggggtcttgctctttcccaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacaggtaccatattggatgcttggctcagagacattgggaactcagcatactggacacagcactgtggcaaggaacgtctaagttctcattcagacactactacaaatgatatattatggcagtgtttcctaaacctcggccaactgtactatcattaatatttttctttatatcaaatcacagttgggtttttttaaactcatcctaagcaatagtatctgtgaaatggtaatgtccaggccagatttggtggctcacgcctgcaatcccagcactgtgggaggtagagttggatggatcgcgtgagcccaggagttccagaccagcctgggcaacatggcaaaaccccctctctacaaaatatacaaaaattagcctggcatggtggtgcgtgcctgcagtcctagcaactcaggaggctgaggtgggaggattgcttgagcccaggaggtagaggttgcagtgagccaagatcacaccactgaactccagcctgggtgacagtgagactccgtctcaaaaaaaaaaaaaaaaaaagtctgttgtgctggttgtatatgtattttccgtaacacacattaaaaatatattagttataaaaataaaatgcatcaatctgtattacctaaaatcatctgtgtagcactgtggttcactttggaaagcagcggattctgcctgactatagtcacttaatagtcacagacttcataaagtttacacagtgctctcaaaaaccaataacagaggattatagggagcctcttcacttgctgctgtgttttttgagacagggtctcactctgtcacccaggctggagtgcagtggtacaatcacagcacactgcagcctcgacctcctgggctcaagcaatcttcccacctcagcctgttgagtagctgagaccacaggcgcaggcccccacacccagctaattctctaaaattttttgtagagacaggtcttgctatgttgcttaggctggtctcaaactcctgcgctcaagcaattctccatcagcctcccaaattgctgggatttcaggcgtgagccactgtgtccagccccatttttttagatggataaatttggggataaaaagacatgagatttctttttaaccaattttacaaattcttaaaaaaaaaaaaaacattgttagcagcaacacttccatcctgtttccctttattacatgtatacagcacttcctattttttaaaagtttcacagttatttctctttgcatgtaaaagaattcttataccaaccccactctgtcagtacctccaaattgactcattttcttatttagatttcatttaaggataaattggatgaacaagtagttattacaaacaaagatacacactcctctagacagcaaaagtaggctatatggccttgatgttttgaaggagaatatgcccagtgttgagcaattcatataaatcttgttgattttaacccatttgtttttttcactttagtttactaatccttagaaatgggtttctgtgtttccttctgtaatcactgagtcacaggtgtgctttaagaaggaaatatgagaaaaatatagaagttaggagatgaattctagacctgactgctaatcagctgatctctatacatcttcattttcctcttctgttaaatgggcacaataagaattgtttaagaatgaatataggccaggcgcagtggctcacaactgtcatcccagcactttgataggccaaggcgggtggatcgcttgagcccaggagtttgagagcagtctgggaaatgaggcgaaatcccgtctctactaaaaatacaaaaaaaaaatagacaggcatagtggcatgcacctgtagtccctgctactcaggaggctgaggcacaagaattgcatgagtctgggaggtggaggttgcagtgagccgagattgtgccactgcactctaccctgggcatcagagagagagagagagagaccctgtctcaaaaaaagaaaaaaaaaaagaaaagaaaaaaagaatataatacttttacctttctcagaggatagttgaaatagtgtgtctggcactatacaataaatgcggaaacacatgtgaaggggtgatagtaatgattgagtcaggtagtttggggtcttgtggactgtgtgtcttttatgatgtcatctgctggtatctgattagagtgtgttagtttaacatacagagatagttctgagattacctcactgaaacaactgttgatgcagctaatatcagaacacctacactgccctgaatacaataatgatgaggatggatggatgttcctatcttcctaacgtaatctctgcatttgttttctgagaacctatgaaacagcccccaccttttgttgtctttcagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctcgtgagtagcacccgagattcagatcatctgttctgccagctgctgttccttaggaaaagcgtttgaattcttgctgctcttcagcgctcatgcggctctgtgttagctcacccttccctttaaatgtttataatgatagaaatcaggccaggagaagcccagctgaacacgcaacgggtttcaatcaagagttgttttcttcattaggtccacttgtacagcaagagacacacggtgcttagtcctctcaaaagccagccctttcttcattggttcatttgtcaccaagattctaacagaatttcaaaaaaaaatcccacatttcaaataaaattatctcacataagtaactaatggcaaagaataatttgtgactgctctggacacagccaccatggggtaatcctgtttagaatagaaataaaaaataatttcttcagaaatgttcacttagattatctttcttagggtataaaccattcccagaaacgaagattcagaacatcgtgctcattcgaacaagaccagtcagcaattcagtatggccctctgcatatgcagcttgaatgagcacggggagagaagaacaagttcatcagggtcagccgtacttttacttagctggtgtaaagcaagaggcctacatgtgccgtcttttatagagttcccgcctgtagagaggccagtgtgttgaaggaataataaggtccctacacaaataggagttctgaccctactctcagaaaagcaaaaactcatctagatctatttgattggctttaaccaaggagacatacccagtcaccagccacataccccagtgagacctttttaaatgtggcccggagcctttcagttacgtgatgacaatatagctagtcccctgctttcttttccccttccaaaaccataattgaattaattcccctcagcaatcctgaggtggaagctcgcataatttcctctcttttatagagaaaactggtgatcaaagaggttaagctcagtgagccgggggtcaacttctgtctgccacttccttcaacactcagatcaaaactcttcctcccagaagccattcgcccaccccagctctgagcagggcgctactccggaacgccccccgcttctccatgctgactgttccttaccctggttgtcgaccttgctctaactggtgcaggcgctcctccactccaaccagcttgtaagctctgcctgggcagagcttgtactcttccctttgtgtatctccacgtggctcataaacgcataaccaaacattaggaccagacttcagtcctttcctcccttcgggaacccctcggcctctagggatggagctgaacaattggtcagacgtgtcagataacacgtgtgccttgttgaatgggaaacaggtaattaatagcagtctccttggtacatttcacttcctcgagcggtcgccgtgggccccttgacaatgctgttgctgatctccagagacaaaggggcgtgcctcagagtactcactgaaagtgagtcacctctgccaggcaaccttcctggccctcattcgcctttgccgcctgacataacttgttttttgtctccttgtgcagtccccgaagtcacaccagcgaatgtcagtggtggcggaggcagcaaatctgaactggttataacctgggaggtaaatgaatcacagaataaaaggaacgtacacgcatcgaagctattttattattttcctccatgttagacatagctgggaagtttcctcctctgtttttaacagtgaaaattcatttgggttcagacactccctctcacgtagctaatggctagcaggaaggacggcacttgcccatccattgttgaggcaagttttaattcaatccatcacagtaaaaacaattatgaagggaagacaacacacgttacaaaaaaaaataaagaaggctgtttcagagaaaactagtttttcttttcttcctgaattgctgcatggccaattgatttaaaacgtctgccagcaatagattcagtgcaccagcacaatttcctggcaattggctttgcttctagaaggggccctcttttaggaggtattttttaaaacaacctggaggaaagttagtcaccaatttattaaaaattggctttgagagaagaggtgggagctttagaaagggttcttcatgtttttgaaagattctaaacagccccagaaattaaaatctctcatttacccaaagcacagcagtgaaagaaatcactcatccctccagctgaactcttccctctgagagggaggatcttcagccaagatggtttttcttccttcagtgagatcttttgtctatttggcaatggaagaagattagtattagaggatacgtgttggaaatgtggtttttcaggagaccgatgtccagtgtttttttttttacaatcatttccaaccatttcagagctgggtctgccccatcaaagagcaagctctggactgcagatcctcattacgttttcaaccctgtccagtacatcataactgtttaagatagactgactgcaagccctaaatttaaaagactgttaacaaaacgccaaataagatgggtggagaaggatgtagacaagaatgttacaagggaaacaaaaacgatttttgcatttgagtgaaactactgtgatttctgaagaccaccttccttctttcccagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaaggtatcgtttatgctgcctagatcattgactgttaatatttcttcaattctaaaatgtggattgtagcacgtacaatcaatttcgcatggtacatgtatcttgaaggcatacctgatttgagaagaggataatgtaaacaatttggttcgctgtccaccatgaatctcttgaaaagatagcgactgctctgtatatgaaaacacttggctgtccattattgattccattgctaaggaccagaattgcaaataccatataagatcttcatatctatctatatgttatcattactttcaaaagaattttatttttgcctttaagtgaatatcaaaatataatttgcattttcttaccacttgtattttcataaagcatatggtacttgtggctcacacctgtaatcccaacacttttgggaggccaaggcgggtggatcacctgaggttgggagttcgggaccagcctgaccaatatggagaaaacccatctctactaaaaatataaaattagccagttgtagtggcacatccctgtaatcccagctactcaggaggctgagacaggagaatcacttgaacccaggaggcggaggttgcggtgagccgagatcgcaccactgcactccagcctgggcaacaagagcaaaactccatctcaaaaaaaaaaaaaaatctcacttattaaagaaaagagtaagtcatgaagcagtgtgattgcgctcactgtcatccacaccatcattatgtttaacatttctcacacattattatcacctccatgctatccctgctctcgggatgcctctcacacagtcttcgttacctttggagttcgtctatgttgttttaaagatgatgctcagaatgggaccatgttaaaacatctgaaaggtgaatcattgatttagagtcagtgaagatgcaataacttattcccaatcagagagatcatccccttagactcagtagccctccatgatctagctgctgcctctctgtctgcctcagctgctgatgcctttccctgcatatttcatgttccaaccattgccaaaggatttacaattattcaaacaagcttcagcccttttcatagccttcaacttctcttagataatagttcatgtctctggattatgaaaatgagaggaaaaggggaaaaggacagtcagctgacttgactaagattcaagagagctggatgacacttcaggttcacactgcaatctgtatgatcttggataactcaggtatactctgtgggcctcagcatctttggctgcaaaggagaggctagactgactgtttcccaaatttcagttatttttgccagatttctgccatagctgtgtaccatttgtatatgttcacatttttctttcaatagtcttccttaaaaaaaatttagtgggcaagcacagtggctcatgcctgtaatcccagcactttgggagggggatgtgggaggatagcatgagcctaggagtttgagaccaacctgggcaacatagcaagatccaagtctttacaaaaaaacattagccaggcgtgttggcacatgtgtgtgtggtcccagctacttgggaggctgaggcgggaggatggcttgagctcaggaggtcaggctgcagtgagccatgattgtgccactacattccagcctaggtgacagagtgagaccctatttcaaaaaagaaaaagagaagcagtttagccatgtcgtaagcaataacatttgtgagatgctaattaagaaggatctgtgttaagggaattgctggctatgaaaacttggtgcttaaacttaagtggttcttctcttctacccacacctaaattcagaacccaaacactggacaaatattcactaccaccaactccagctattaatcactgcccctctgcaaaatgagggtttggcttacaatcattaaggacgattctataaccatgaattattttaccttataatgctagtatctacaatcctgtcctaatatagctgatagagtaataactatctccatattcatctacagaacccaccaaaccaccagccagtatctttgccagaagtctttctgccacagatattgaagttttctgggcctccccactggagaagaatagaggacgaatacaaggttatgaggtaggcaagacatatgtgccttgggtctgaaagagagtctatgccccttgataagtcctccaagtcacattcttataggaagagacccacattcccactaagaggcattggttttaggcctggcttccagctgaacattaatggaagcattgaatactcagctgtgagactaccctttttctatgttatattctagaggtatttttcgaattatatgcaaatctaagcatttacgggatggttggcaaaatgagctttgacttctgatatgcccaggatcactttgactcaaaacaaacatgggaaaaaagaaaataatgaacgacggttgtgtcaatgtaccgtctcactaggaagctaaggacaaaaaagggacccttcttactttggataatttctcaggatatacagagtcctttgtcctgatagctctgctcatgatgtagtatagaaaactaactccatcataagaatctgcgtacaaaattacctgatgacattgcaaatatccccattgggtatggtttccaaggtctttctgtttatcttcttaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccacgtaagaacagacttgctcagaaatattttggggattcatcacacatatcccaagtttattccttatccccacctcccaatgatcatttgcatactaattagtagcatgtggattcaaatttccctcagcattttaactgaacctttccgtataccacgcaaaattcattgctgtggaggacagaaagataaatgtttttctcctcactgggaagggctacttcttttagctataaatgttaggcgaccaactgaatctttttccatttgcaatgctgtatctcatcagattttagtgaccttgaagacacatattagtgcaatagcccattaaattgcctccactctcgaattctagtaaggagatattcctcagaatccattgagacttaataatctgtgacttcgtatatcttaatttttttatagcaccaagtcaaccccccggaaacatcatatggaattcatcagactccaaaattatcctgaattgggatcaagtgaaggccctggataatgagtcggaagtaaaaggatacaaagtaggtaatttcttttttgcaaaggcacctaatcgtgctgtgagtgggggcagtctcctccatgaattatacagttgtctgcattgtcagtttccctggtgatgctctcctaccctctaggaatcgctgcctccaacacggtttgatctgagttgtataaatagtctatggcaattggtcaggatttagacaatcaccttaactttagtctcaggcagcatcaatcagaaatggataaagaccctgtgtttgggtctccaaaaataccctgaagaaccactttttaaacattcctactgtcagcttcgttttgctcctgtctcggtttatatatattttttagtcaacttagtagcctcctgatattaccaatgattaatcatttttgttcgtatgtttctatagtcaagagttatataaagaaaaagagaaaagagagaaaaagcaggaaaagtggagaaaatgtttgcctgaccccataaatgttggcttgtctttaatgagaaaatgaaaagaacatgtctgtagccttcttgcagcaatcaaaaagggttataaatatcttgcaacgtttccagctacctatttgctacctaacaaaccaacctgaagctaggggctaaaacagcaacagtgtatcattttttatgactttgcaatgtggatagggccagaatggacagattttagggctggaataactaagatgcttcttcacacacttttggcttcttggatgggataggtgggaaagctgaggctggccagtgatcatgctctctatgaggcctttccccacggataacctgggcttcctcacagtatggtgacctcagagtagtcggatttcttacatagttgtcagcttcaagaggaagaaagcagaagctgccagcccttttaaaagctaaggatggacgtgggcagttccaagatggccaaataggaacagctccagtctatagctcccagcgtgagcaacgcagtagactggtgatttctacatttccaactgaggtactgggttcatctcaatggggcttgtcggacagtgggcgcaggacagtgggggaagtgcaccgagcataagctgaagcagggcgaggcatcgcctcacctgggaagggcaaagggtcaaggaattccctttcctagccaagcaaagctgtgacagacagcacctggaagatcagggcactcccaccctaatactaatactgcgcttttccaatggtcttagcaaacggcacaccaggagattatatcccatgcatggctcagagggtcccatgcccggctcagagggtcccatgcccacagagccttgctcgttgctagcacagcagtctgagatcgaactgcaaggcagcagtgaggctgggggagggggcgcctgccattgctgaggcttgagtaggtaaatagcggcctggaagctcaaactgggtggagcccactgcagctcaaggaggcctgcctgcctccttgccctctgggggcagggcatagccaaacaaaaggcagcagaaacctctgcagacttaaatgtccctgtctgacagctttgaagagaatagtgtttcccccagcacggagtttgagatctgagaatggacagactccctcctcaagtggttccctgacccccgagtagcctaactgggaggtaccccccagtaggggcagactgacacctcacacagccaggtacccctctgagacaaaacttccagaggaacgatcaggcagcaacatttgctgttcagcaatatttgctgttttgcagcctccgctgctgaaacccaggcaaacagggtctggagtggacctccagcaaactccagcagacctgcagctgagggtcctgactgttagaaggaacactaacaaacagaaaggacatccacaccaaaaccccatctgtacgtcaccatcatcaaagaccaaaggtagataaaaccacagatatggggaaaaaatagagcagaaaaactgaaaattctaaaaatcagagcacctctcctcctccaaaggaacgcacctcctcaccagcaatggaaaaagctggatggagaatgactttgatgagttgagagaagaaggcttcagatgaccaaacttctccgagctaaaggaggaagttcgaacccatcccaaagaagttgaaaaccttgaaaaaaggttagacaaatggctaactagactaaccaatgtagagaagtccttaaatgacctgatggagctgaaaaccatggcacgagaactacatgacgaaggcacaagcttcagtagccaattcgatcagctggaagaaagggtacctgtgatggaagatcaaatgaatgaaatgaagcaagaagagaagtttagagaaaaaagaatgaaaagaaacgaacaaagcctccaagaaataagggactatgtgaaaagaccaaatctacgtctgattggtgtacctgaaagtgacggggagaatggaaccaagttggaaaacactctgcaggatattatccaggagaacttccccagcctagcaaggcaggccaacattcaaattcaggaaatacagagaatgccacaaagatagtcctcgagaagagcaactccaagacacataattgtcagattcaccaaagtcgaaatgaaggaaaaaatgttaagggcagccagagagaaaggtcaggttacccacaaagggaagcccatcagactaatagcggatctcttggcagaaactctacaagccagaagagagtgggggccaatattcaacattcttaaagaaaagaattttcaatccagaacttcatatccagccaaactaagcttcatcagtgaaggagaaataaaatcctttacagacaagcaaatgctgagagattttgtcaccaccaggcctgccctaaaagtgctcctgaaggaagcactaaacatggaaaggaacagccagtaccagcctctgcaaaaacatgccaaattgtaaagaccattgatgctaggaagaaactgcatcaactaccgagcaaaataaccagctaacatcataatgacaggatcaaattcacacataacaatattaaccttaaatgtaaatgggctaaatgctccaattaaaagacacagatggcaaattggatagagtcaagacccatcagtgtgctgtattcaggaaacctgtctcacgtgcagggacacacataggctcaaaataaagggatggaggaagatctaccaaggaaatggaaaacaaaaaaaaggcaggggttgcaatcctagtctctgataaaacagactttaaaccaacaaagatcaaaagagacaaagaaggccattacataatggtaaagggatcaattcaacaagaagagctaactatcctaaaaatatatgcacccaatacaggagcacccagattcataaagcaagtcctgagtgacctgcaaagagacttagactcccacacaataatgacgggagactttaacaccccactgtcaacatcagacagatcaacgagacagaaagttaacaaggatatccaggaattgaactcagctctgcaccaagcagacctaatagacatctacagaactctccaccccaaatcaacagaatatacattcttctcagcaccacatcgcacttattccataattgacctcataggtggaagtaaagcactcctcagcaaatgtaaaagaatagaaattacaacaaactgtctctcagaccacagtgcgatcaaactagaactcaggattaagaaactcactcaaaaccgctcaactacatggcaactgaacaacccgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggagatagagacacaaaaaaccattcaaaaaatcagtgaatccaggagctggttttttgaaaagatcaacaaaattgatagactgctagcaagactaataaagaagaaaagagagaagaatcaaatagatgcaataaaaaatgatcaaggggatatcaccacccttgagagtgggtaacagggttagaccagatggtaggaaaggacactttctgagttcttcttaatttccagctcagtcactcccccttctttttaggagtggtactggaagagccagacaccctacacctcctcaactacaccccaaggaaggtcactgtaactggctatacattttgaattgctacatatacatgtgaatgtttagagatacataatttaaagctacaggtatccacaggttccatactctcaaatgtggatcaaaaatattcaggaaaaaaaacacacaaaaaaatacaatgaaaatgacacagattttaaaaacaatacagtataacaactatttacataccatttacattatattaggtattatgagtaatctaaagttgatttaaagtatacggaaagatatgcttaggttatacacaaattctataccattgtatatccaggacttgagtatccacagattttggtattttagggaggtcctgaagccagttccctgaattaccaaggtaccaatgaataactctctctctttctctctctctctctgtgtgtgtgtgtgtgtgtgtgtgtgtgtatttgtgtgtgtgtatgtgtggtacctcccgtgatatctcacgtcccatgatagctcaggaaactctccctagtgtcacttttagggtgagattagaggctgaataaaaagcggatctgattgcaacggaagagttgacctttgctagagaatttgacccattaaatatggctattgtttatctcagactgaccctttccaaaattaagttttcctcccaaatactgaacatgttggggtgtgggtttattttcccttcttcactaagttgtctgaattctttagatctcagcttaggtagacagtctcaacaagaagctgactttagaaagtttaaggccccaaatattttgtcaacacaaatccttaagctactttatggcattagagctaaaaggagagcatctggttttagtatcacaaattaaactacctgcagggccaggcagataacataaatgagttctgttcagtccattcagaaactactactaatacgtctactaagcactgttccaattcatcttaactttatattttattttgttgtattttgagacagagtctccctctgtcacgcaaggtggagtgtagtggtacaatcttggctcactgcaacctccgcctccagggttcaagcagttctcctgcctcagcctcccaagtagctgagactacaggcgcccaccaccacgactggctgatttttgtatttttagtagagatggagtttcaccatgttggccaggctggtcttaaactcctgacctcaggtgatccgcctgcctcagcctcccaaagtgctgggattacaggcatgagccaccatgcctggcctcatcttaactgtataataaccatgaagataggtacagttattattgctagttttacggatgaagagctgtggcatagagtttagtcacttgcctttcacacagctggtatgttgaagacctgggatccgaatacagcagtatggatcctgagttctacatttagccacttggtgcttctgcctaccagccataaataaatagaataagtgataacaaagtactgcagagaaaaagaggctagagtgaggggaatagagaaagccatggagtggacaggagagatgtattattttatagaaaggccaaggaaagccacttttaagtggtgagatttcagttgggccttggcacctctctgggaatgtcccaagtactgcaaaaaaggaagtgcaaaggtccagaggtaggcatgtgacaatgtagcaacattggaagtgttgggactatcaccaactgcagagtttgtgattgttcagaatgagacttctcaactccaaccagttgttggcagacaggaatatagatcactggcttagtctattttattctggatcgcacttttgtagagtcttactcaggaacagaatacctgagactgggcaattaatatgaacagaagtttattgacacccagtgctgggagggagagggatagagagctgactcgcccttttacaacagtgctaattccatctgtgagggtgagcctaatcacctcatggcctaattatctcttcaaggttcacctgttaatacagttaaaatggcgaatttcaacatgagttttggagaggacaagcatccaaagcatagcaaccagtgtggccatatcttccagtttttcagtagaacccacaaatttttaatgtctaatttctcggtttttaaatgttcatgtctaactcaaaaaaaataacactatgacagccaaacaaataatatatgcaggctggttatgacccatgggccactagttttttgctgtctaactcccttggtttgtgttcccaaagacagatgccagagagggaaagcaatttgcccagagccctacaggtggtagccaaggtagtcttcgttaaaaatccaggttctgaggccgggcacggtggctcacacctgtaatcccagcactttgggaggccgaggtgggtggatcacctgaggtcaggagtttgagaccagcctgaccaacatggtgaaaccccgtctctgctaaaaatataaaatcagcagggcatggtggcgcatgcctgtaatgttagctacttgggaggctgaggcagaagaattgcttgaacccgggaggcggaggttgtagtgagctgaggtcacaccatcgcactctagcctgggcaataagagtgaaactccgtctcaaaaaaaaaaaaaaaaaaaatccaggctctggagccagactgcctaggtttgaatgcaggatccgccacttaccagtcatgagaccgggcaattgcttcacatctccacatctcaagttctcatctttgaaatcagaataataacattgccttccttaagaggttatccacataagcatttagaacaagcttgtacagcccacagcccacaggctacatgtggcccaagatggctttgaatgtggcccaacacaaattcataaactttcttaaaacatcgtaagatgttttttgcaattttttaaaagttcatcagctatcattagtgttagtgtattttatgtgtggcccaagacaatttttcttcttccagtgtggtccagggaagccaaaagattggacacccctgatttagaacacacagtgttcagacattaaatagtggaagtagtctataatatttgctattatcattattcccacaaatccattctttccccttgtcttccaccctagattatatcaaatgcaagcacagccttcaatcagctcaagcaagtgtttggtgtaaataaaggctttacaggactttatttgggttctgctgcagtccataatactgcaagactgataagcagtgctgataaaagtgctgctttttcctggaagtgtttcttttggatttatatttgaaacaagttgaatcctctgagctcttgcaaggaccagaggtaaatcaaagcagcaatttattcctcaaagccagatgtgaccttgcatcccatcagcccattctcctggagggccgtgatgagaagctttgacactcctgaatgtgcctgaggatttatctgtgcctaatcatcagcaaggggatgctgggtctgatacaactgatgctgcggagaagaaggggacacttatgaatctttctaccttaaggaaattgtgttttccaccttgtgttagagagatataaattaaggtgatgaaatgccagggaacagatgggttctaaaccattctaaaggaattttatgaatttcacttgtgtctggttttgtcttgagacacaagagtgaccttatgtctgtagcctcagcagatcagaatttataagggatcttagggaaggatgagctaatctcgtgcttctcaacgcatgatccctggaccatcagcactggcattagctgggaacttgtcagaaatgcagattttcaggtcccatcccagaactaatcacaaactccaggaatggggcccagcaatttgtgttctaacaagttctccaggtgattctgttcacgcttgaatttgagaactacgcgtctaattcatctaatcatgatgcctatcccatattaacatctcctgatgatcttttagaaaacaactacagcatggatcccacctctgtgcagtcttaggcaggctagagtggaactggagcggggttactgacctcctcacagtcaacactttgagctagagagttctttgttgcggggctgctctgtgcattgtagactgttcagcagcatccctggtctctctatccactacaacaggaggacatgttttgacaaacatgtctgcagacattgccagatacctccctgtgaggcaaaattgctcccctgcccctcccaccctgttgaaaaccactgagctacagcataagtattttacaagcaccccaatggttctaacatgcagccaggaccaaaaaccactgacctcatccaaccctatctttttgtcaggggaaactacagaggatgagctttagtggttctataggtaaaggcacactttcccagacctgtatattttgttcctgattggagtaaatccaatcacagcaggcaatcccaggtaagtgaatgtgtttttaggaggctagttggccacctcatcaaatgaatccacctccaaactcagaacccatggggggcccaagatgaaaacaggactgttgcaagctgcagatatgtccagggtgacaatggttgcctcttggctacctagccccataaagtggggttccagaggaaaggaatgggaggttactactcttgcctttccgatatcttctccctgtgctgaaatgtcctgtctctaagagtcgtgatcataacttattgtgcctggcttgtgctctaacctttgccatgtatgttctctgattatctttaagccttcagagatactatttcttacatgcttcctctaagctaggccatcaccagattcaaaccttgtgcaatcttttgtatttttatatttttgagacagtcttgctctgtcacccaggctggagtgcagtggcttgatctcggctcactgcaacgtctgcctcccgggtgcaagcaattctcctgcctcagcctctggagtagctgggattacaggtgtgtgccatcatgtctggctaatttttgtattttttgtagagacagggtttcgccatgttggtcaggctggtctcaaactcctggcctcaagtgagtcacccaccttggcctcccaaagtgctgacactataggcatgggccactgcacccagcctccttgtgcaatcttgaaaacacactccagaagactgggtattattgtcccccttttacagatgactgaagtgaggctctgaaaggtgaagtggcctgtgatcccacagtggccaagtttattctgatgccaaagcaccgatgtgtaactgagcactgtacatccttaaggagctactcatattttccactttcccaagagtgtcaactgagcctccgagaggctaggcagtaggtagaatcacgttgctgatgcccctgatataatatcctttcagctctttccttggaataaaatggtagctgcagtcatggccctcactgcaaatgagccttccaaatgcaagtgggcagccagacaacctctacatccctgcattttgctcgtgcccagaggtgaaaacaaatgaatgctccatatttgggacctttgtgaagacggcaggtgacacctgttctttctgtattggcaggtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaagtgagaatgcctttttttctcccttttctcctgcctgtcttatcttatcagccttccagatgagtcagggcttgaaagacattcagcctgcaaaagcagacttaaaatagaaatggagaacactaccccccttctccagatgtttgctggccataggcagtttcatgcaaaaatcagtttgcccgtgttgactgatctactcagttgctaatcaaaaatcagattaaagcagacccgaattagtcactaaggtttttccgtgtcaacctgtgtagtttgcattgcatctattgtagccccagaattacagtttagaaagtgaaaagcattgactcagtcagaaggaacaaggacaagcattgttaagtatgccgtagcagtttttctccagtgaaacagtgtatgcagttcagtatcttggaaatatttggaatttactacttattttcaatgggtatatgcaacatgtgcatcaatgtgtatgtctctctatagtcaagattatcttcactttcaaatgttgttgaatagcatgggagaatagcatattctttttgagcaaatacattcaattctgtttttacaaataccatgtttgtaagtatcttaagagcatgatttttttgttgttgtgtgtgatctcatttatttaaagaaaaaaaacaaaatagccaaatccgtggagacagaagtgaggctagtgattggcagtggctggtcagtggggaatgggggtttaggcactgggtcttcatttggggtgacacaaaagttatggagcttgagagtggtgctggttgcacaacactggagtatacttagtaccactgatttgtacattttaaatgagttaaaatgctaattttgttatgtgtattttacagcaataaaaaaaagactgtggttagatatctaagtgtagactttcacaggctttcagatttcagtctggagattaggggagcagtgaaggctggaggtataaattttcaagacattggtaaaaagatgatattttaaattatggacaaaatcctcaccaccatcctgacttttagccatgtgacatccctctgctaaggggtgatatgccagtgtttctggatggagtttatatttactgcatcttttttgcatacaaacacaaaaggcatttttgtcttaaaagggggacaattggattatactttatcaaacaaagcctctaacttctatcgaaagggagctagatttttggtgagatgtggaagtaaaatctccaggccacaaaaatacaagattggggcttatctcgcttcattaaaaatctgactttatacttcatactttcttatcattgcagggattgacatttttagatagactgatgattcctggttttattcattacaaaaacatatattaagcaattatattggtgtaattattagataacaaggaagtgactgtgaaccaaacatgatctgtttcaagagatttttcatcatgttggtcaaagagaccttacaagattgaagaacccccgaatgacagttgatagcttcttactatgaaaagtgtaagacccataagaaaatttaaaaaaggattgaggctattttgtttgcagaaaaggggtagatttagacagacatgggtttgaaccccagtttagccatttactagctgggtgatcttagataagttactttatttctctgggcgcaaattaccgccatctgttaagcgaggtaataataatacctggccttcatccagtttttgcaagatttaagtgtcatattcatctgtgcccagcagaaagatagagttcaaaagggagcagcaattttcattttgttgaatcatcgacatagcatgctgtttatcagtattgttactagtaatattgaagtttcttctcacattagataggaacctccttactttacaaatgctttgacagaggtacagggctgtcctataccctactcccaggtttgtagcttggtagtcatagaactgatatttaaaagccattaagaccttgatcatcatttccagtagaatccatgcagttctgctgtttcaaaaagccccgtggcccctcttccctttgaagccgggatggggctgttttgagtgaatttgttctctcttttcagatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatttgtaaagatacttgtctttcgggagcatttttcctgcctgcctgtcagggaatttgttagcttacctttgtgctagttataatttgggatcatagagggactcaaaagtctctacccaaatctagatgacccagagcttttcctttggaattgacaaccctgaagcaccatttcaaatcctctttggaagtagagagggtcctaatccacaagtaaatgtcctgaagatgagacttgaatattttctcttgattagctaagtcttttgtatatttactgtaagtatatctgttgtttccctcaccccccattgctaaaagggtaagttctaagcttgagcatttaaggctcttttttttttgagacggagtctcactcttgtcacccaggctggagtgcaatgttgcgatctcggctcactgcaacctccgcctcccaggttcaagcaattctcctgcctcagcctcccgaggcgcccaccactacaccggactaatttttggatttttagtagagacgagatttcaccatgttagtcaggctggtctcaaacacctgacctcaggtgatctgcccgcctcggcctcccacagtgctgggattacaggcttgagccaccgcacccggcccttaaggccctttttaatccaaaacgatttaactgtgtatccagccacagtaagccctccctgacccctgaacactgcttgcttttggtctcacctctgtgcctttggtcttatggctgccccttcctgaaatgccttctccacccttctctcccattcagatccctgctgtcctagggtagctccagccccagtttgtctgcaaagacttcccatgcttcagtcctttatgacattctcgcttggaagtagttgcatcccctatcaatgctgctcatttagtaattaatcagatactacttttggaaatctcttgtactgttatcttgcattttaatttaactcctgtattgttacttactttttcttgtatgtatggcttgtcttcccaactagattgtaagctccttgagggcagggactttggtcttatcttccatgtactctccatagtgcctagcacagtgccttgcaataaatactcactgattaattgaatgaaggggtctttgaagtagcattttgcatcagttgcctgcctgtgtgccacagcaaaccaaccagggaagactgtgtcattactttcgttatgtgctgaaaagcgttaaaaggcctggcttctaactttgtacctggaagaagtctttgaccaattggcttcatcatcgggtaaatgaggtcctggattagttgagtctaactgaattgaagatgttttagaaagtgccccatgagcacctccacccaaacttgtctcatttgttggctttcatggttgcctcaggtagggtccactggctgtaagcaaagaaacgaccctgggtaacttgagcaaacaaaaagtaaggaattagaatgacacaggttacatcatatgagccaaggaaacactgaaggaccaactcttgaggagaataagaaccaggccactctgtgggtccagacaatgggaactttggaaagtctttttggggtgctattgtggggatgaatcagctttgtttccaattttgacgccattatgctcaatattcagattcctgggaaagtgatcagttccatttgagttccacagccagagtaccttgtactcacaggggagggatagttaaaggaaaactaagatgctgttttccaaaggtaagagaagaaatgctgggttggtataagtaacagattttctaggcttagccagccaaggggactttcttaggcccttagcccaagtaatacactcgagtggaatgactatattgctgcttgagatttttttctgaaggaggaccactaggaaaatttgctttgcttgtttaacctttcaaagtgcttactcttgccctcctttttgtgtgtgtagtccacttgtgatttaactgtatgaaaggaaattctattgtgccagatatttggattctctcagtgtacctactttctatggagcccacacatgctacatacaaagcagcacctttccatgggcacagaagacatggatgataagcttcatttctcaggtaagctctgaattcttccagcctgtgaggtagaaggtgcatagactttgatattaagaaagaatgattgtgttattcccaccatcaaaattgtggttgtttatatccaggaggcaatgttaaatcctgattaacctttacccagtctcttccaccaccttgcctcactacaaatatgcgcaaagaatgttgagttataaaaagtatacaaatagcacataattagcaacaaaaatgtcatgcagtttttaatctaatgtaatcaaccaacaggtgatttttgttcactacattggattatcgatgctactgttctcctccgttaacacttataatcaagaagtgactgttattttcctgttgttacaatttacaaaatgttctggctaaaaacgttatgtggccaaccatagtgctttgaaaggcaagcctttaaaatcaaggacttatattcaatctgtggacataccccagatttttccattacaaaatgccagacactgaggccttacaaaggcagcctaatacaaagactaaggacgtggatcctggagtttgactgcctggggtgcattgtaatgattggctacttattagggaggataaagtttgtaaagctctccaaacagtgatgattttaccgtctgttattgttctttttctccagggactttactagacccacagatgtaggatgtggatgcttcttatcaccaaaatgagtggaactcagctgacacatccattatcaccttttatttaaacatgatcacttcttaatataaattttaatgttcgataattttaatcatacaatcaactaattcaaacttaggcagtagggttcccattcagatgccaggttttgcacaaagcctccctcagcttccccatctgaaattgaccttgcatttctctgacctccaggggatggggtctgtacccactcatgtcagtcatcccttcgtaccttatatttaaatcatttttgttggtgtcttccgccttatagtagacacacggcacctcagcgttggcatctgggtgtggttcctcattgtgctcccaggcacaaggcctgtgtcacctccatctcagacctagagggaggagaatatctggccccgtttcctgtgatttcctcaggccccctgccagagtgtgattagtaaatgcaagtcaggctgcccattctgcaaagaggccccgtttccccttgtgctaaatgggccatgcggattaaatgttccagctctgcaactcacctgcaaactacaatactcaacagagatcacagtttaaacaaaattggcctctatcctttatcacaagcagttatgggccatggtagattagcagagctctagtgatatagatcacatagagagaaagctttttttaaaaaaggtcaaccatatgatcgatctgaaagtctggaaattggaaggctgagctacttaaatatagatgcaattacatgtgatatccccattctctgtaaactgggtttttgccacatatccttattgttaggaataacacgaactataccaggaaatatatatgtcctaggactttaacaaatagtaatatctttaatttgtttttctagttttcaaagtgcttttcacactaataaggggaggacataggtttttattccttttttatttatgaaatggaagcaaagaggttatataagaagcccaaagtaacatagacaattagaaagtcagggctgggcatggtggctcacacctgtaatcccagcactttgggagactgaggtggggggatcacaaggtcaagagttcgagaccagcctggccaacatggtgaaaccccattcctactaaaaatacaaaaattagctgggcatggtggcacgtgcttgtagtcccagttacccaggaggctgaggcaggaggattgcttgaacctgggaggcagaggttgtagtgagctgagattgccctactgcactctagcctgggcaagagagtgagactctgtctcaaacaaaagaaaaaaaaaaaaagaaggactagaatttagaacatagactcattagtgcatttcatacacctagaaataagtacttagagaaaggacaggatggagtaaggaactagactctgaagttcaactagagaacattctaggacaagtaggtaggccagaggaaatggtgaggtagaagggtgagatgtctgaggttcagatgctggaggtggagaagttctgagtgccggccaggcccagggcacagccatctggaggaatgggataggataggtgcctggagagggttttagttattcagcaagggactactggcagccctctctgtaccaggcactattctgggcatagaagaatgatgtggcattcagatgtgtgtgaggaagccaaggcaccagtaacagtattttgtcacaatacagagaaatgcaatgataataataatagtaaacagtgattatgcttataatatgtgccagactcagtgcaaatcaacctaccgatttagttaccatttattattcctattttatacacagaggattgaggttgacaggttcacatttgtccctgatcacacagttgatcagagagaccaggaattgaaatgctggtggcttgggtttagggccctactccaaaacattagatgtctctatctgtaaatagatgatacataaacaataaggtaggtagatagataaatagacagatagatacggttcccatatagcaacaagaaggaaaggcagtcatgagcttcagtctgctctaaagtggctcagcttctctgcttctctttccttgactgcaaatgttgttttttgcgtgttcgttgtccttgacttcaggtgtcttagagctgtttctttaaactccggctacccttcaagatcaggattacccaataaaataggagaggagctattaaacttagatttcagataaaaaaaaaattatgcttccttagtataagtatgccccatgtgatatttatttgaaattcaactttaactgagcctcttatttttatttgctaaatctggcaacctgacaccaggaggtcttcattactctcattgaagtaattaatttgtaattcaaaatttcagggtcttgcgaatgtgttgtcagatctctgaaggtcaatggctctgagggcgagacatgaagtttgctgttttgagttctgtttcgtttgctgaactctccttcccacttttccttggatggtgtgaggatgggatgtgtgtgtgtccagagagacagggctggtgggtgaagttcctcttagagctggcagaaaagaggttttgttttttttttgtttgttttttgagacggaattttgctcttgttgcccaggatagagtgcaatggcgcaatctcggctcactgcaacctccgcctcccgggttcaagtgattctcctgcctcagcgtcctgagtagctgggattacaagcatgcgccgccacgcctggctaattttgtatttttagtagagacgggtttctccatgttggtcaggctggtctcgaacccctgatctcaggtgatccacccaccttggcttctcaaagtgctgagatgacaggcgtgaggcaccgcacccagcccagaaaagagttttaagacaagggaatctttccccagcaaaggcccacattatgtggcaagaaggtgttaaagcaggtggaagggattccagaaatattctgaaagcttaaaaaaatgggtttgttgccaggaacataggccacagcacagctcgttggaaaactatgtagtggacgcatcgtttatcaactgcagtgttgggaccaaatatccgagaccaaataactggcagttagaattggcccagttgttcctcttgaatttagtggttaacaaataagatattgagtgcatactatgtgtcaagcacttgctgggcactggagaaactgagataaatagggttaaggcttccctcatggttcactgaaggagacagaaatacacttattgaaggatggtgtgaatagtgtgacagataaaggtatgaacacaatgctggacctgtgtttcttgcaaaacctacttataatgaggttaagttcagtcaaacacaattttttttaccattgatcccccaggatagaatattttcatttgattaaacatgattattttcccaaattggttgcttttcttaaaaaaaagaaaaacacattcataaatattttgaatccattaagccatgtgtcaatattggccctctgggaaaatctagctcattgcccgctttttttgtaaatcaagatttattgcaacatagccatgctgatttatagattgcctacggccactctgtgctatcacggaagaactgagtggctgccacaaagaccatatggtcctcaaagctgaaaatatttactatctagccctttaagaagagtttgctggctcgtgcctgtaattccaacactttgggaggccaagggctggatgatcacttgagcccagtagttcaagaccagcctgggcaacatgggagaccctgtgtctacaaaaaaattttataaattagctgggcatggtggcacacccatgtggtcccagctacgcgagaggctgaggtgggaggatcatttgagcccgggaggtcgaggctggagtgaacggtgatcacagcactgcactccagcctttccagcctgggtgagacaggagaccctgtcttaaaaaaaaaaaaaaaaaggcagcagcagcttgccgacctttaaactacgacaccagtactttattgctgatttcgttcttgcaattttcccctcaggtttctgtgttcttccagtttattacttggcagggacaaatctttgcttttaattttaataaatgaaacaaacctaataaaacaccttcaagttgaaaagagtccgctagaactttaaaatcatgcacatgggccatatgggcggctttgtgttgctcctgacaaccaacaacgcagatgtctactgagagccaaatggtgggtgatgccggccgcggaggtggagggcagcgtttctgagaccagcatcacacccactgtgagtttttactacttcattaatttaagctccagtgacgatttaacttctgctataaccacacagctttaataaatgaacctaccattagaacatagttctttagaatctatattgttttccgttcttttaaatgtttaataagctcacttccttttccttcgtctggttactcaaccagcagtcagttcctccttggggcttatggacacaaagataagtcagacactgctcttggcctcagagtgtttgcactggaaacgagacagagcattggtgaggagtccaggccaggtgcggtggctcacgcctgtcatcccagcactttgggaggccgaggcgggtggatcacgaggtcaggagatcgagaccatcctggccaacatggtgaaaacccgtctctgctaaaaatataaaaattagctggctgtggtggcacgtgcctgtaggcccagctactggggaggctgaggcaggagaatggcttgagacccggaggcggcgattgcagtgaaccgagatctcgccaccgcactccagcctgggcgacagagtcagactctgtctcaaaataaataaataaatgaaagtccaatcactgatagaattaaacaaaaggaacatagagggacacttaattcaaactggaagttgagcaaagattttcaggtggcaaagagccgagacttagaagataaatcaaaatgtcaacaaaatgaaaagaggttgaaaaggctttttccaccagagaaagtttcggcagaggcatggagtgatgcagtagcatggagctacagggaaatcatcagcacattggtgagaatggaggtaggagtatttgggtatgtgcctggagagctagtaaggagctgagtcatagtggactttgccttaaaaggagctttaacttgaaggtgatggggagttatataggcagatgtgccttttacattgatccttcaaagggaggaaatactggaggccatgagttcagttcagaggctactgtaatagtcctagctgagagatggaggaagacaatggtggggacagagaaggggaatatttaggggaaaaatgagaaaggtacccacccctctttaattgcagacttagacaattcactgtcatttatgtttaatatttctcattctgaaacatatttatattcacatctattacctacaaaacaggagataagcatgattgtcttatagtacaatacaaaattccaaaggaaggaatggttttgaaaaaatttgcaccctggtactcaatttgaaggatgtagaagcaggaatagctacagtccttaggctagcaccaagtcctattctaattaggtttttcacctttacttgtgccatcagagattgttttcagttctctgttctcacttccagatatctactttttctttaacaaattagcacctcaggcttcttaattccaccagcagatggtcctgacacatagaagtctcaccatgaaaacgtttggatttttaatcaggatgttctttgcccacgtggattcttccccagcctgcatgaatagcttgaggtctgaggcatttcaatgaggctcaggtggtcgggctgttggcaaatgtgaccttcaccctccagtctccccagcactcccccatgctgcacgcagtgaattccaaatgccaaggaaagaaattgggctaaaaatccctattggaacggatatcttggaaaagcatgtttgttctgatcccgtggctgtggaggctctaggagaaaagtgactctctacactcgtcctagtgagagatggcaagagatgggagccaatatcatgactttaccttacatcaacctgctgctgatggtgtttactgttaagtgaatttcaaactctttgacttgctatgacaaggctggtgagaacagtatagaccactcacagtgagccacttctgaaatgcctcttacacagcaatttatacataaccatttagacactttggcagcaaaaacatccaggttgcagtagcccagttgttaggcacatgtgtctcctggttgcttctaactaaccgcattctcattagatacccagcttcctccccctgtcattattgtaggccttgaggatctctgccaaatactgttcagtctaacctatatacaaggtgccgtatcagggctgacagagggtttaagaaacatttatattttcttaagtcagatactgtcctagacactgcagataaaaagacgtatttcacacaagctccatcctcctggaagccgcagtctagaggggaggcctcccagctgttaatggtatattctacaatgcagtagctctaacacgggtatgaggcccagaatgagaatccagaggcgggatcaaccaactctgcttttgaaggcttcatggaggaagtgatgatggttacgggttcccaaagaatgactatgagttgcacagggcaagaagggaggaaggagttcccaatccaccaaggaggccaatgggctactttgtgttgctcctgaaacacatataccaagggccagataacggtaccagctcagggaagtgtggcaaggagctccacagagcccaggtgatctatggctgctgagtggagggaggagtctgaagtgggcaccacaccaagcactgaagagctggccacatttgtggagggggagctccctgcttctgttcctgcctcctaagcagaggcagtttccacaatgccaactgtctgggttgtggt

SEQ ID NO: 1236 - DNA, 29707 bp, Homo sapiens
gacattcactgacaatgctctcaccaaagtcataactggcacacccagggcactttctgtctttcttttatttaacatctctgcagcactgacatttggccattttctcctgctcaaaattctcttctcttgatgttttaaccttgttctctccaaactctgtccacctgtggtagttccttccctgctctttcttggctctctcctttactggctctaatgggtcaaggaaggtccttttagccccttctcttctcactacacactctttttttttttttcttgagacggagtctcactctgttgcccaggctggagtgcagtggcgtcatatcggctcaccacaacctccgcctcccaggttcaagcaattctcctgcctcagccttccaagtagctgggattacaggtgcccgccaccatgcccagataatttttgtatttttagtagagacggggtttcgccatattggccaggctggtctcaaactcctgaacctcaggtgatccgcctgcttcggcctcccaagtcctgggattacaggtgtgagccactatgcctggccagaacttcgatttttattctgaatgagatgaggaaacactggaaaaatctgacaaaggtgatgtgatttgaataatgacttaaaaggatcactctggcttctgtgttgagaatagactaaggggtggaaagcatggaacagggacatcatttaggaggcagctgcaaaactccaggtaaggaatgatgaggcttggaccagagtgttagaagtggaggtagccgccaggcttagtcggtcatgcctgtaatcccagcactttggaaggcagaggcgggggatcacaaggtcaggagttcgagacccgcctggccaatatggcaaaaccccatctctactaaaaatacaaaaattagctgggcatggtgacgggcgcctgtagtcccagctactcaggaggctgaggcagaagaatcccttgaacccagaaggtggaggttgcagtgagccgagatcatgccactgcactccagcctgggtgacagagcaacactctgttccaaaaaaacaaaaacaaaaataaataaaaagtaaccactggatttgacaatctggaggtcacactggcaatcttgacaggagctgttttcatggagtggctggaacaagagcccaatcgaaatgtttctaaagagagggaaggagaagtagaaactggtgagttttacttcaaagagaagcagagaaacatgccagtacctggaatgtaatgtagagtcacaggggtattttattttaagttgggagatattacaccagtgtcaaagattacagtatttgggcatggcaggcccaggcatggtagctcatgcctggaatcccagtgctttgggaggctaaagcaggagaaatgcttgaagccaggagtttcagaccagcccgggcaacagtctctacaaaaaaatttaaaaatagctgggtgtggtggtgcgcacctccagtcctagttactcaggagggtgaggtgggacaattgtgccacagcactctagactaggctacagaggaagatctggaagatcccctctgcaaaatgaaaaaaagggctcagtaaattcaagatatttgatttgggtgtcactggtcaactcggtgagacgtttcaggagagccataaaagtaaaaatatttcatgaattaaataattaatggatcattagacaaaatggattgtgtgtacagatttagatgggaaggggagaaaaaaacaggaggtaactagaaggtgatacagagtcaaggttttttgttttttgaattcttcgtttctaggctgtgtggaaagagctacctggacagaaaagcctgaagaatcagaagaaagggcaactgatggtgcagggactggtctcagacaagtaaggggtcatttcaccctatgaaggtaagggaaggtaaggaggtagagatagaataaggtaggtagaggtcaaggtaggatggcaagggggggatttcaggcccgatggtctctaactccctaataaatggcaatgaaaagtttcttcttgtaacaacagacattcttggtttgaggagaacgataaagctttatcaaagctgcatgcctccctaggggcacctaggcatgtgactgaggccacatggccacagtgtcctcaggaccctaagacggcacagagacagtggatggagtgtagaaggcctgggaacgtaaacatacatgcagtggatggacaaggtaaggacactgagagcacaagtatgagagtggcttaaggggtggttgatggttggggtgaagcagaggcatagaaaagacatgtagtttctataagtggggcgttggggtggccacaggtagatttggggatagagcatgagactgctagaaggatggaggctgggccggagtggcactggatctcagaagagggatggatctgaaaaggagatccagggagagggtgtgagagctgatgtggaggaagcagccacaggattagaattcacggcatttcttgcctaatgaggttgcctgggatgactgggaacgggtggagaaagaggcctgagcccgcaccaaagcacaatggaacggagcttaggatgggtggcggaagtgtggggcgggaggagcgtggggcgggaggagtgtggggcgggagcgtggggcgggagtgtagggtctggcttgggtatcactttaggtgtgaaggacgggggttgagcgagtcagagcctagagtctggtttgtggtctgagtgtcttgcctggtacgaagagtttctaacagagtctgggatccctctgagaacaaggaatgtgaggggataagagggatgcttggtgcagagatgtgctcttttgtacgggatgagagcagcacaggaagggaatgcacctgtgatgtgggagagaagtcttggagttgggctatgaagagtctgggcgggtcctgaagtgcaggtggaggaagccagaggtgcgtgtgggaacttggggtgtgaggtggtgtgtggactccggggtcccaggtgtggcaggtgtgagggtaagaggggcaggctgcacggaatgagaagcccagggtgtgcagacttcaggatcaggagtgtatggtgtgaggacatggagattaggttaagggggtgaaggactgaggtgagggatgtaaggtggggagagtggggtatggagtgtgcagtgaggggagcgggggaggggtgaggcggggtgaggcggggtgaggaggggtgaggggtgaggcggggtgaggggtgaggcggggtgaggggtgaggctgggtgaggaggcgggtgaacggtgacgtgagcgatgaggggtgaggggcgaggcgggtgaggcggggtaaggaggggtgaggcggggtgaggggtgaagggtgaggcggggtgaggggtgaagggtgaggcggggtgaggggtgaggggtgaggcggggtgaggggtgaagggtgaggcggggtgaggggtgaagggtgaggcggggtgaggggtgaggcggggtgaggggtgaggcggggtgaggggtgaggggtgaggcggggtgaggaggggtgaggggtgaggggcgaggcgggtgaggcggggtgaggaggggtgaggggtgaggcgggatgaggggtgaggggtgaggcgggatgaggggtgaggggtgaggcggggtgaggggtgaggcggggtgaggggtgaggggcgaggctgggtgaggaggcgggtgagcggtgacgtgagcgatgaggggtgaagggtgaggcggggtgaggggcgtcgggggaggggcatggggtgtggagtgagtggagtcgggtgagtggagttgggtcgaagtcaagggtctggcttgaggttggtgccaccgcgaacgctaggacagggtcaggcggagcccagccgtcagggcgcgttgggagggccggggcccaggggggcgcggcctcgctcacctccagcttggcccgcgctccggtcctgctctggcgcccccagcggccgcttgaggaacaaggccgctcctcgagagggatgccccgccctttccgttagcgaaccctccccggaagtgacctctcgccctcattgggtgtcctcgggaaaaggggcggggcattccgcgctgctcccacaggtctgcggcgtccgagtctgggactggcaggtgcggtgctggggacgtcctgaggttgagggagaatcctgcggagatgaagagcttcccggcctgacagttttgcccccacctccttcttgagcttaaggatttatacgcagggccccgtttgcctgctgtgtccccagtgtccaggacagcgcccggtaccaaaggtgctggtaaacatttgtcgaatgagtcgctgaacgcccagctatttccactgtcacagcgatcatgtgtggcggacattatgtggcatgtatcttacagaggaggcagcccgggctcagggagacgaggcagaggtgcacgcaggtctatgtgggctggaaagtgctggggcctcccgggcgctcctggtctccaggcaagaactggaagcagagccactcaacacctagaagggcagtgacagaaagctctggctgggaggaggctgaccagaggccagtctgagctcagccttttttttcagagggacgtgggcaccctagaagggtggtaagtaggcgagtggcagagttaaaaggtctctggctgccgaggcgggtggcgacggggccggccgttgctgttgtttggctgagtggtggacagggtcaaagccattccaaggtcgacttgacagggcttggtaatgtgggagggagggagaaagaagcaaggggctaatggccggggtgataccactggcagagatgtggaagagtgggagaagctagcttggaaggttaactttgattttgaacaccttgtgtttgagaatcctgacaaaccttagaccccctgaattttctctcagggattctgattcttagcagcctgattgcagaggaggaaaaatggctggggttgagccagacagttctgggcaaggagtgagcattcgcttgtttattgaggaggctgctgcctgggccacactccctccgccagctgccaggttcctgccccggttgaacccggttttctggccatccctttccacctgtgagctgctcttcatacttccatttgcttatacagcccagagccgatttctgttacagcagcccagagaaacatgaatagggaataattctttttttttttttttgagacggagtcttgctctgttgcccaggctggagtgcagtggcacgatctcggctcactgcaacctccgcctcccaggttcaagtgattctcctgcctcagcctccctagtagctgggattacaagcacatgccacaacgcccagctagtttttgtatttttagtagagaccgggtttcgctatgttggccaggctggtctcgaactcctgtcctcaggtgatccacccgcctcggactcccaaagtgctgggattacaggtgtgagccactgtgcttggcccgaatcaggaataattctgatggctaaggaagacagcttccgagagagtaggagaaagggcacaggattccaggcagaaggcccatctagggcaaaggcgaaggtgtggctcagcctgcctcctttggggaatggcgagtgtgttctgggctcagggttcttggtaagggacagagaagactcgggaaagatcagttgagctggaatgtgcaggctcttgagtaccctgctcaggagctggaggtgggctaccctgcaaactccaggccatgaagcccaggaagatgtcaggctggtcttcccatgcccttgtgtatctgagaccaactgtcactaaatgtttcctttacgccctggacacacagctagactctacttctcagattctcttgaaatacaagtctttagccagagggtgtggagggaaatgctgtgtatcactttgaggttgaggccatcaaagcctcccacaggtggccccctctttctctccccacgtacttatgatgttgatgcccaaggcagcttgagtactacctgctgaaggcagggcctctgtcaccatagatccttgaataacagtatggagcagagccctcatctcagccaactggattttatctgaccaacagtccagcttctattgggttgagccatgaggtttcaggatttatgttatggctgctagcttttattaatgcagacctgcagacctatgggacatggggaactaattggggtttgggttgtcatcagaggtttatttatttttttaagacagggtgttgctctgtcacctaggctggaatgcagtgggtcaatcatggctcactgcagcctcaatctctcaggctcaagtaatcctcccaactcagcctccagagtagctggggccacaggcaagtgccaccacgcctggctaattttttttttttaattttgtagagatggggtctcactgcaccacccaggctggtctcgaactcctgggctcaagacctcccaaagcacaggcattacaggcgtgagctaccatgcccagcagtctccagaggtttataccctggtttaccactgttgttcctcatctcactattttaacccagaacaaatgagataaaagaactttaatgctgaattttgatgttaattgaaagctagcttgttggaaactctgtttactgctatctcaggacggggtgagctgatgtccccagaagactaccaaaacgcaggcaccttcccaggggaggcttactggcacccaaacaggtagaggtctctggaaatacttttggaagctgaagaacgctctgatatggaatgtaacattttgcaggcagaggtgtactctttttttttttttttttttgagacagagtctcggtctcccaggctggagtacagtggcaccatcttagctcactgcaacctccatctcctgggttcaagcgattctcctgcctcagcctcctgagtagctgggactacaggcacgtgccaccacacccggctaatttttgtatttttagtagaggcagggttttgctgtattagccaggatggtctcgatctcctgacctcgtgatctgcccgcctcggcctcccaaagtgctgggattacaggtgtgagccaccgcgcccggccccaagaggcatactcttatagctcatgaagacttgaaggaggtgaggagcctctgccctgggaatcctctcatgcactttcaaggttttaactgtcttcaaaactgttagaaggagcctagatctctccttagcttttcatttatattttcaagagtctgagacattttcacagctatttcttataggcaagtcaaattcaacatttaaagacctaatttaatcacccaatcacccaatatagaaaatatgagttatctttgattcctcctgattagacttgtcagtcctacgtttgacattccaagctccttaattctactttcctatggcactgccttagtttaagccgctcatttcttccagctccaccaccaccaggagcacttctccagcgggtctccttgcttccactgttactgcgtcctactttgttctaacgccaccctggttagccagtgatcccttaaaattaggacagattatgccaccctctgttcaaagcccaacagcttcccccgtcattcagaaaatccagaatctggcctacgaggcccttgttaccccgatctagctgccccgcttgctcttcccatccctgactccacactagccacatccttcatcacagcagacaccgctcgcaaagctttggctcttgctgttccttcagccaggaatactctgcccttaggtacggaacatgagggacatgagggacatgacttgctcctcgtctccttcaggcctgtggtcaaaggaccccaatcaggaaggcttgcttttgccactgtctgaaattgccacccacctctccttttgtctctccacttacttttcctctttttttttttttgagacggagtcttgctctgtcgcccaggctggagtgcagtggcgcgatcttggctcactgcaagctccacctcccaggttcacgccattctcctgcctcagcctctcccagtagctgggactacaagcacccaccaccacacctggctaattttttgtatttttagtagagacagggtttcaccgtggtcttgatctcctgaccttgtgatccacctgccttggcctcccaaagtgctgagattacaagcgtgagccactgcgcccagcccatggtgtcttataagtgtcttatataagggtaccattttttttttttttgagacggagtctcgctctgttgcccaggctggagtgcagtggtgccatcttggctcagtgcaagctccgcctcctgggttcacgccatcctcctgcctcagcctcccaagcagctaggactacgggcgcccgccaccatgcctggctagtttttgtattttgtttagtagagacactgtttcaccgtgttagccaggatggtctcgatcttctgacctcgtgatccacctgcctcggcctcccaaggtgctgggatcacaggcgtgagccactgcacctggccataagggtgccatttttaatcttttatataacatttttactataccttttctatgtttagacaagtttagatacacaaagacttcccattgtattacagttgcctacagtattcagtatggtaacatgttgtaaaggcatgcggcctaggagcaacagggtaagcagcatagcccaggtctgtagtaggctgcaccatctacctttgtgtaaatgcactctagaatctttgcacaacaaaatcgcctaacaatgcacttctcagaatgtatccccttcattaagcaacccatgcctgtacttggtaagtggattatcccaaaagcctcctggtttcctgccagctgctctgtcccctgaccacacctgcctcacccagcagtgaattcgacatgggcaggaataggaccttgtttaccactgaatccccagcacagggccaagtctatggtgggtgttcaacagacactggttcctggccgggcacggtggctcacgcctgaaatcctagcactttggaaagtcgaggtgggaggatcacttaagctcaggagttcgagaccagcctgggcaacatagtgagaccctatctcatgggaaaaaaaagaaaaaaacaaaaacagatgaagacactggttcctaaatgaaggtccagaactgaatctaattcacttcaattacagtaattgagggcctacttatacttttcataaaaattattttttatggctgggtgcggtggctcacacctataatccctgcacgttgggaggctgaggcaggtggatcacctgaggtcaggaattcgagaccagcctggccaacatggtaaaaccctgcctctactaaaaatacaaaaaattagccgggcgtgatggcgggcgcctgttgtcccagctactcaggagctgaggtacgagaatcgcttgaacccaggaggcagaggttgtagtgagtcgagatcgtgccactgcactccagcctgggcaacaagagcgaaactccgccttaaaaacaaagaataattattttgtatttactcttaacatgattttagcagccgagccaacctcagtgaaggagtgtctgttgctacaggtcatcctgcgtgccctcttgcagacatgaccacctggcgcctcaagacttcaggcctgggcctgcagcccctttccatgctgacaagaagctgcggggcccgtgcagggttgtgcctcagccaagaggggtgcctcacacatgcccctgcatgggaggaggtgggctcactctccagcagacagacaaacagaaatggccccagggaacaggtgaaggttctgaggcaagtatttattccaagcaaacacgtgggcgtggacagctatctcagagcctacgtcactcagcagagtcacacatttcaaagcaggtcacacaagtccctcatgaacagtcttccagcttcagcccttctcttgccacctctgtggtctgagctgggggagggggagggcctccgagttcccaaacaaaacacaggtacctaagggctgagagaaaattacacagccttatttttattagtatctatcaagaaaaaaaaaaatcaaaattcccttcctgctccaaccccacctccaccacctgggccctcagggagcagcatctgcccagcgaggacctgctgccggagctgtccttggagcctgggcacctgtgcacggccacccctcatgcctgtgagctgccacaggtcccttcctccacagtgtggggacgaaagggcagctggcatttctccaaccttcagctgtaggccttgggaacttggaaaagatcagcaatgtccagcagggctttgcggatgtggtttccaaagcgctgggcgttctgtgggagccaagagttcagatgcaccttcagatatgtacccacccctctgttcccacaagcaaggatgcctccccagccaaagacacctgtgttcctgggcagccccaggtggcaccccttcctcaggcctgagctgtggcaggagactcaccgtctctgagcttgagaacttgctggagatgtggaagaagatcgtgttctcgcctgcaatcatgtaggaaactccatagccatcatctgctacctgagggcaacaagaagggtgaagaaggcataaatcaaaccttgaagatctgaaagccaagctgatattgtacttgttcttcccacaagagttgcaggaacgggccccagccctagacactgcatttttcctgaggaccacccccaggaaactgtgaaaaccaaagaatgctgcccagaccccgccaagggatctgggacctcccagtttccctcagggggcttattctctagatcactccgtctctctccagagggttctctagccttctgacaagctagcccatgtgaaggtttctgtgggagacagctgcactctcttggataagtagacttcagaagcacccagtgcactgcccagtaccctggaaaccagccccacagtcatgcttcagtaccccggaaaccacggtcatgcttcagcagggaggtatttgggatgggtgggtcccaggtgcttggctgcctgagtccatagctaacattctgcttccatgcaggtctggggttatgctctcctctaagcaaggtgctcctgcctctcgtctgacctcagggcctgcactcgccactgaaaccctcagggccctggtgctgcccacccacccccttcaggagcactcacagggccaaagccacctccagcgcccaggtgattggggtgctgctctgggtcgaacatgcggatctgggattgggggatctggctggtggagagacgccagggttccgagagcacctgcaatggaggccacagctggtcagaggccacatacccaaagcacctgtccaacacgtggtgtctgcgacctactctgagccagacacggttctgctgagggtgcaggagctccctggccaccaccccgtggtcccctgtgcatcatgccacataaggcttgtgtgagctgcccagccctccctctgctctgcctctcccccacatagcctcactagtctcagtagtgctgtcaccacctgacagatcatatatttgtctgttccctgtcacaaggacaccaacaccacaaagaggatgttgctcctgctcagtcccaggaccacaggcccaggtggggtgtgggcgggaaagctggcccagcactccagggagcttcaggggagcaagccaggaaaacaggccgtgctccatcatgagatggcccaagccctgcgtgtaggagggcagtgggacaaaggacacacccaacaacggtgctgacctcagcaaggaaaggagagctgactcctaggtacttggagaccaagtaaaggcagaagaggtgcctgtcgatccctgccccggtcatggccaggcggtacatattctggtgcttcttagcagccttctggaagagatctcgcaggtctgctttctgcggggcagaagtaaaggggtgaagagtagccctggccctccaggcagacaggaggcagagggggcacctcacccgacgactgtgacccccacatgggcagaggacacttactgtgtgggacccctccatcatggcctgcacaaaggctgtggactcgctggtacaggaacgcacagtctcagtccgtccctcccggaacattctggtcattgaggcctcataggtcaggcagaacttacccctgtcctgggatatacagaggggtgaatctggcaggtggaccctggtaccaccctgccctctcagcagcgggaggcggggctcctacccggaagtgagccagctgcagcgcgatctgcacaaaggcatcagggctggtccggcacttcttgatgaggcctttgccaaagggcaggaactggaagcagtacaactccacgtcgtctgccaacgccttggccacctggtaggaactctcgatgaccgcctggcactgccaagacatgggaagggtcagctgagggtagggctctccaagcaggactctgggtcatgtctaggaggcatgacgtttagctggtggagaaagggcacagccggccaagacatcttcaggaggagggtacgcaaaagacagtctgagggagaatcagcccccagaggccgggctcagctttgtgggtaagagggaagtgctgaaaatgctccaggggcctgtgagtgcctcctccatctcatggctgtctctaaacacagatggccccaggggcggtgggtggtctctgtcctccctgaagccagtttggactctacaggtatcctgagacgtgccctgtgccttcccgagggctgggccaggcagtgaggccagcaggggaggaggaggctcaggcctcgtcggggctgtacccacctgctgctttgtggtctcacacctgctctgggagcttccaacccacctgttttggaatgtcccactgcagccgtgtaggaggtgcgagcgcagggttcggtttgcccaggcagtgcccggtctccgtgtagcccaggtggaagctgtctgtgcccaggacaaactgcagggagaggatgagactgagaggctggcctcatcccctacagcctgccctgcaggttccctctgcaaggctattacctcccagaggtgcccaatgatgggagcatctgcccacgcatgctctgcattgagacccaactggccattcttgaaggaaatgagagtgaaggatttgtcaaaccacctgcaggaagagtagacacatgaagaaccaaagctgggaatgtccagaggtgcctgacctgcaaccccaacctttaaccctaattactaaccctattctctctctctttttctctcactttttttttaaattgagatggaatcttgctctgttgcccaggctggagtgcagtggtgtgatcttagcttcccataacctcccgggttcaagggcttctcctgcgtcagccttccgactagctgggattacaggtgcctgccaccatgcccggcttttaaccctattctataacccaaaccctagcttttaaccctagccactagccctacccaaccactaatcacaatcctaactacttttatgaaggggtctcgctccgttgcccaggctggtcttgagctcctgcactcaagtgatccacctgccttggcccccaaagtgctaggatcacaggtgtgtgccactgcacccagctcataaccctaccttcttttatctttaatcctctaaccataaccctaacttttaaccttaagctgtaacctgtggggctggggctgccgtacctgttgtagcagttgccatgtagcagggccttgccatagaggctgaggctggcctcatcttcggggtcataggagtaggattcctcatccagggccacgaagaaagcggcacgctcgatggcctccaaggcagccttattctttccagagctaaagaaggcctggcgtgcctgcgcccactccaccctgaagcatggggcagggtaagcagtgggcacgtggacttgggatgagggtgcctctgagggcctggctggacctggagatgggggtggggtgccaggctggacctggagatggggggtaccacgctggacctggagatgtgggggtgccaggctgggcctggaggtgttggggtgcgtgccaggctgcgcctggaggtgggggtgtgtgtgccaggctgggcctggaggtggggggtgccaagctattttggagggtgtccccaccctctgcacacttcacctggctgccacccgtcagaggtaggttatgctggctgtcctgctgccatgaccaccaatgcccctcccctagttgtgcctccagcctccagttccagggtggcaggcagggccacgctcctctcctcacggagccctgaactcagggtggggacagtcccttcctagaggccaataccttcctcctgcagtgagggctgccagcttctcctccccaggctgaggtggggaggggtcgtccaggatcctctggaactgcatctccagatcctgaggcttgagcagacgggcgccctcatagagccacagcttgaagaagcgtcccttgtggtagacagccacgtgccggctgtctgagaggtgctgtagcacatctgtgatacaggccacgggcaagctgaggcggggcccccagctacatcctgggaagggcccacctcccatgcactaggtgacccctgcagaccctgttttgctcggcctctgcctgggccttcctgccccctggatgggatccgtgtgtcctaaaccaggccctgtgctgggtgcttccactctctctcacgcaacaccaacaatcctataaagtatttcacagaagaggaaacgacgcactagagggttgtgcaaaccgcctaaggatacagtgtcagaagcagggaaggctgctgcctctgccagacccctgggtgcgcccctcccctcctctgccggctccatggcagcgccgggtctgtcctaagctttgggctgcagcaggactcccttcaccatgcgcagtgagccccggaggggaggggctctgctctgggccctgtggggtccctgcgccagcatcatgcctgtaaacaatggatgtctagtatctgtcacaattgactactgttcacagtttcaggaccctgagacactggggacgcttggtgatgagcaggcaggagggcagcgagccagccagatggcccacaggtagcagcgagggggctcagttacctgtgtccttgcccgggatccgagtggtgttgaacatcctctccatctggtaggagcacataggcactatgcccagtgccatcacctgagggaaggcccagcatggctcagactcaggtctcccctcccatcccaccttcaaccctgacgcaactcacaggcttgatttcttcacggtccagtttacggcgatacatgatcatggcgtggatgatgtttcccaggcgggctgcctgcacgtctgtattcttgatgagcacaaggtcctacagaggaacagagcccgcggggtgggggcctctgtctgggtgtcacctgagtcttgctgacccaaggaccaatctattcgggggcctgaggtgttctgtctccctcttccagtacatcctgcacatgctgccggggtgaacctccagaaatgcacaactgatcgcagtaaccctctgctccagcttcagcctgagctgctttattctttattttttagagttagggtcttgctctgtcgcccaggctggagtgcagcggaacaagcatggctcactgcagcctcaaattactcgccctaagtgatcctcctgctgcagcctcctgagttgcagggattagagtcatgcaccaccacgcctggctctgagcttcctttttatttgtttatttatttttatttttaaatttttatttatttatttttctgagatagagtctcgctcttgtcacccaggctggagtgcagtggtgcgatctcggctcatttcaagctccacctcccgggttcacgccatttgcctgcctcagcctcccgagtagctgggactacagacgcccaccaccacgcccggctaattttttgtatttttggtagagacggggtttcaccgtgttaggatgctctcgatctcctgaccttgtgatccacctgcctcggcctcccaaagtgctgggattacaggcgtgagccactgcacccggcccgagctgcctttttataagctattttatgtgcttatattctacttcttttgctttgataaaggggttctaccactaaaaagcagtttaaaacctctgctatgggcaagttgtgtgtaagttcctggaaggacagcttatggaggagaattccagtaggctctggcaagtcaagtgtgctttggaccgtgggaaaggagagaagaggcatgccatacagcccaggtggctgggagacccagagactcagaagggccagttacatggggcagaggcagactgacttcctgagctctaaaagcagcagcctggcctccattctgctgtccggctctgcagagggacacaaagcaagacacgttctagacaattccctggttatggtgtcaggacagctgggaacccatggccaggaggccagtgaggaaaccaaggaaagaggtgacagagcccgagctgggcaggggcagtgaccccgggactctgagaagcggtggcaggctggcggtctccactctcctcatccttaggatccccattgcccctaagctgcttctggactcttctaggatctcctctctctcttccctttccctcaggcctcactccataacccccacttgcccacggaagctgctactagagctctgggctgtcctccagatcccttgccttggagctgggacagagctgagcacgtgcggggacctgggggctctagttcataccatgacataatagttgctgttcaccatgagagggctcctgcctcgaaggtagatgtactcttcccaccagtcactcacctgtggggaggtggaaggttagagctggggcgggtgcagccaggacacatggcaggtgacagtgagcccaggggcaggaacttacatagttacttgcccaccatgacttgagcaccaggtatttctgcagcctgggggcagtcttgtcctggaattctttggccagcaactccatgcggtaatattcctcatcatccaacaaggggcgcacagactctaggtactgtccagccagttatcatcaccgtggggccagatggcaagggctgcctctatcttaatcctcttcccacctctccctcctcacccagccccattattctcaagcccttaaggccactctttgcacagaaccttatatttggaaacatctcctgaatccaacctcccctgcccactgggatgcccaagcgaggccctcacccgctgaattgtggctgacaccctgggcacaggaagcttgggcagagatgtctggaagctgtagagcatagggtgccggctggatagaaggcggatacacatctgggggtacagagcagagtgctggggtgggagccagtggaaaaaatggaaaccaaccagcaactccctgagaccctcagagccatcccagcccctccaggacaaaccacacaccaggcaccagtgccctgtctgcctctcccgtctagctcagaaccccaaaggagtccaaagagtctcaacccaggtgcctgaacccctccactggctgctgctcacagcccagatcctggtcaagttgctggtcttgccatgcatctcaaacatccacccatggtagcagagaagcagcttcagggtttggcggaagaagaagatgcccgtcacccagacgcccgtggagaagatggccatgctgagaagtgcccgggtctgcggggtctggtaggggccacacctattggagaggggcaagggctgcagggggtcctcttgaggccagcctcgggtggctgtgaactgtctcaggggagacaccaaggggaagaacctccctgggcacactcatgtctgactgcatcaaatgagcggatgtagggctaagacaatggttgtcataggggagggctgccccgtgactgccaatggctgctgtcctgtatctgcccagctcaggaacctcagccttgggagctgggcccagccctccctggtggcacctgtgcccttccagtttcactccttacccctgagggaggcatctctggatgcaactgaccagccccaaggagatgtccacgttgcagaaggaggaacccactgttgccatgatgacgaccagccagctggtggggctgccagggtacacgcccctgaggatgccattctgtgggcagaaacaggcgcccttatggagccggaaggcgggaggttagcctgcctgtgaagtcttgggaactggctcctggtcttggcctggaaggctttctctcctgatgccctgctgtgctccttcctccgccacacccacagctccctgtgtccgaccacatcctgtgcacccctctggtgtctgtacttccacaacctgtaccgggcagaagtgccagccaaggaggcagtgagggaccctaacaaagcgcttaacagctgacagccggcctctgcctacgctctgggagaagcacctgtgcgcaccttgatgcggatcaggcgtttcttccaggagttgatcccagacaggtagacgtgtttcagggcctcccgactgagccggaagtcgaccccgtctggggtcaccgtgaactggaaggccacggcctggtgagcttccgccatcctgggggttggtcggcacctaggacgggggcagatgggtgcgcgggcgcgcttaggccggccccgccgccagccgcgccgagacgcccccagccagtccgcgacccctcgcgccccccaccccgcgactagcggctgcccccggcccgcgccccccgccaggccaaccgccgccaaatcctcgcgccagccttccgggtgggcacagccactgtggtgcaggggatttgggccttgaaagctccaggagccccaaggacggcgaagggcagcctggagttggggggcgtcagcgagggcgcgggcaggggagagaggcgcccctggaagtggagccggcctggacagaggcagggttcgggagcccgcccttccccacccgagcgcgcgggccccagcgccgtcctcgcccctgtgcagggctgagggcccagacccccgcgggccgccctgtgccggcccctactcacagctcgggttcactcctgtccgtgcgtggggccagccactctggcccgtgtccccacgtccttcaggcctagccacccccgccccgccctcaccaggaacctgacacctactcccaaatcggggtcggggaaaaacgtggggcgagaaccagaacccacccaccttccgcggtgggaattgcagggcgcggctgggtttctgtgcggtgaaggttgctcaaaggtctgggagcctggggggccccagagtctcgtgaggatggtggctttagagctaaaaatagccaaatgtagggaaaaggtcaccgatgtgtcagctgctgcctgttctgggatcgctggtgctccgggcggcatccccacctcagggtcgtcttcatacccccatcactctcctcctccccaagtcctagtatttattattctaagctgcagccaggggactggggagggatgggggaccccaactggcagcatgaacgctaaccactttcaatcccagagcactgaagagtccctttgtgtgtactgctcggtttggtactttctgctgctgctcagcagggccaggacagggtgggaagaagaagcttgtttattgtgttacatacacagcacggggctctggcctgccagccatggggacctactcaaactcaggaacaggccggtctcctgaacctcagtttcacttgggggctcagcccagtcgccagggccttctgctcgttgttcctccctccaaggtcctgccctggaggctccaggagaaatccaaggagtgggagggtggagtcaggatgaggagtggacactggtcagctgccccttctgctggaagtagaactggaaccgagactgggcatagtcctagggaaggaaacccaccccacacagtggtgagaagacgtgggaccagcattctacatccacctcaggctgcccacagccacccgggactccccaggcctcctggaagagtgtggctgctgctgctccccagccccccagctagcattcccatccccagggtcacttaccaagtaaccaaattctatggtggacatggatgcctggaggatggaccacagaccccagaagaaatgggatgccagagcatacctggggggagggcaggaaaaggaggggcattcaagagcatgtctagcactgcttggatcccctcacccaggttggccaatccctacagttttaacttctcccccactgtcctaactccactctccacagccaccttccctgcagcttgataaatctgcctcttccccaatccctctttcctctgctctgccctaccccaccctgcccctccttcctcaccgactgacttctaccagcaaatcttcttccagttttctctgctcctcttgggagagggtctcacctttctttgcctctgccaggtaatgacgaataaaatgcaactacgatcaatggccaagagtcaggaattggggagactgtggagtatttcccaggtaacatcctttccggccattccttccagactccacctccctccttcctcacaggatgggtcctgctccccagcctctggcccacatacctgctgttcttgagtggggtagtctgtgggccttgctttgtagaaaggccattcctcgtgagtataatcataaacccactcacaaaaatggttcccaatgtcaaagcccctgggagaataaggtggacattcagtccccaaatgccctgggcagctggcctgttttcaagagccctatgggaacagatctatgggaagccatctttccagcctcacctatagttataactgctgtactcgaagtccaccagcatgaggctgtcagcattttctggctctgagagcagcaagatgttccctgggggaatggggtgaggttctgctcactccagagccctctggctcttccatcttgggttaggagactcagatgccttctcctaccttcctggatgtcattgtggcagaagacgactggcgatggggtagactctagtaacttcctacaggggtatgggagcatgggtcctgagcaggagtgactagaggaggatcagagccaccctaacaggccaggccctgacaccagccctcagcaactactggaagggcggacaccattaccattagccttgtcctgcctgccctcacctgaggttgcccatctcatccttcaggctgtacatctccagcaggttcatctcagggaggccagttgggggcaggtcctggatctgttttaggtacctgaagcccaaagaataggatacactggctctgctattctttcccacccctcgcctatctacccctcaggccagactactgcacccctgctcctatcactgtgtgacttgtccggcaatcatttctttttttcttttgaaatggagtcttgctctgtcacccaggctggagtgcagtggcgcgatcttggctcactgcaacctctgcctcccgggttcaagcaattctcctgcctcagcctcccgagtagctgggactacaggtgcatgctgccatgcctggctaatttttttgtattttaatagagacagggtttcactgtgttgtccaggctggttttgaactcctgagctcaggcaatctgctcacctcagcctcccgaagtgctaggattacaggcatgagccaccgtgcctggccttggcaatcatttcttttttctttttttgtttggtgttttgagacagagtcttgctctcacccaggctgaagtgcaatggcatgagctcagctcactgcaacctccgcctcctgggctcaagtgatcctcccacctcacccacctcggctcccaaagttctgggattacaggcatgaggcactgcatgtggcctctggcaagcatttaaaagcctgttctgtgacagcccatgacatcagatccactcaagtggagggctggatagagcccccgacacatccgctggcatggaggttcagctcaggagtacaggagccctgaggaggctcctgactcaccgctccatggtcccaaacagccagtggggctccttggtgaaaggcatctccatgccatgaaattgcgccatcttcgtggcaatggctgctgacaacactggctctcgaagctcttgagttttcaatggccgactctgcacccaggaagctatcagggtggtgatggggctggggcaggagtgggaagggctggggcaatgaggggaagtcagggttttgggggaaattccctacttggggtgagggatgtggaggcagacattgggcactggggtagggttagggggtggaggtgccttggggaggagagggtaggactgggcccgtactgggatgtactgttccagccggccctctgggaagactccgtacagctggggccccagcgaccgctccgcaagtatggcgaacatcacgctttctagcaccagggagtccacgccctgaaaaaggatggacagcaaaggggccaaggcaaagtggcacagggacacacatgagggctcgccttcctcccaccagagctgcgacttctgatccaattgcctggaggctctggagcacaggctttagcgttggtctatttttatttagagatgggggtctcactatgttgtccaggctggtctcgaactcctgtgctcaagtgatcctctcgcctcagcctcccaaagctctgggaatacaggcccaggcttcggtgtaatgaggtgttactcagaccgtgaacctcggtgtcctcaactgcgcaacgggaacaatactacccgcatcgcgtaagcgacaggccctaaagccactggtgctgcggcgctcacacccccctcacctgcaagatggctccgtacagccgcagaagcacctcccggggctcctcgccaacgctgggcaggtggtccgggagcgagcagcggaagagcaggttgctgaggcctccgctgcagacccacaccaggcgcgctcagcccgcggccggccctacctgccgcggccccggccccctcccggccaggccggccccgccccgccccaggcgcgggcgcaagaggggggcgaaaacatggagcatcctgagggccccgcggctgacccctgaccccgatccgcgcaccggagaggctgacccctgacctcccacctcacggggtaaaccctcagctcctcgggctgcactcggcgccaggccccgcccaagtactcccggcaccattggtaggctcggcgctcggcgtcacgcgacagcgacgaggcgcgccgccgttttggggtagtgtccgggcacttagactgctgcaagccgtctttggccaggcagccgccaacagccccgcttccggccacagctgtcgcctcggccgccatggcgcgggctcgaccgggccccaggccaggctgcgctccgctcccttcggacgggctcggttccttccggccgcgctcggctcctcttccggccggcctgggcttctccggtcatactcgggtctctccggctctattcggctcacggctgcggcgctcggctctctccgtgccccggcccgggggctctttccgaaggccgaattccgcagatctctgccgggccccgcccctatgggcaaggaccaatggtctctctctgggcggggctgctgttggacggcctgggccaatccgaggcgccggaggccaatcagttggcggagcggcgcgtgcgcgggcgaggaactgcccgggcgcggtagcgtacgggaagaccggagaggagctgcgtctctgccccgtgggagccggcggggcggcggggcggcggctgcagctgcagctccggcgcgagggctcccttgccgggccctcttccccgacccctggggcgctccgacaaggaagagccgtccagcgcgcgtccgtcctgagcgtgggtgaggcctggaggaggcgcgcgcgctaggcagggccgcacagcgcgggcagagtgcgggatgcgggcacccggtgggtacgcagtaaacatttgctgaaggaatgtgacccttgggacagttccgatgactccagttgcataaatgcccagtctacacggggactccctggccggtagagccgcacctctgaatgaggagtcttttgctgccccgcttgagatgcgcgtcttcattcattcccctctccccctatcctcctcgtctcctccaggcctagaaccaattacagagtcaaacccaagagccgaagaaagtgaagactcgcagcttgccgcagccccctcctcggcctgcgcacctcccattgagggcgtcctgatttaaacgcgtgcctcctgcatttctgcttctgccccaggctagagcggcgaccaggaacgctggacccacagagatctgtggcaatgtctgtcgaaccatggtgttctttggggcatctgactagagtattgtttgataaccagaaagaaatcaaaaattggtgatcacaaggctaatgtcacttttgctgcagtggaaaatcatgatcattctgtttaaatctgagtcagttttgagacctagagcccattaattgacaaggaggcttggttcctctcaggaaggatcttacaataccagcatctgagcatataccaagaaatattcctccaatccttccctaaagggacctagagccactttaaaaagtaactggtccgggcgtggtggctcacgcctgtactcccagcattttgggaggccgaggcgggcagatcacttgaggtcaggagtttgagaccaccctggccaacatagcgaaaccccgtcgctactaaaaatacaaaaattagccgggtttggtggcttgtgcctgtaatcccagctacacgggaggctgaggcgtgacaatcccttgaacccaggccttgttgccgcgagccactgcactccagcctgagcgacagagtcagactcagtctcaaaaaaaaaaaaaaaaaaaagaaaactgattctggctgggggcagtgggtcacgcttttaatccctgcactttgggaagccgaagtaggaggatcgtttgagcccaggagtttgagaccagcctgggcaacatagcaagaacctgtctttacaaaaattaaaagattagctgggcgtggtggcaggtgcctgtggttccagctactctggatgctgaggtgagagaatcacttaagcccaggaggtcaaggctgcagtgacctgtgttcacgccactgcactccagcctgagcaacacagcaagactgtctgaacagcaacaacaaacacaccaaaaaaactagtttacttcggaaaagggactgtctaggtctttgaagggctgatacaggatctgagctgacactgtttccaggagccctgaagcatcatggccctctcattagggtgcaggcttatggaaatcagatgataagcagaattcccaacccgagtcctgtggttacttctctggtctcaatgcatacttgggatgtttttacctagcagagggcggagcgtatacattgatcccaggcctttggtaccatatgtaaggaagcgcaaagtagaaacctttgaaactcctcaccctactgaaacctttccaagatagtaagtcagaaacaatgctgcattccaggtgtaattgcagaggtatttcgccctcaaagacttataaagcagtggttaccgtttcatcccttcaattaacctgaatggctcctgctaaatcttggtggattcaagtaaatgatgatgccctgcacaaacttagccaagtcgtgtccccgatcacacagctgtgctaggtgtggtatctttactggaaccgataaatgcacctctggctcttgataatgcaattattgacttggtgaacattcttttcaattgccagtggtaaagaggattaaaagcagttcacatttatatgggaaggacagctctgtaaatggtcttgcttcttgctgtctgaactctcctgttctctgtcacaatagtccttaggtagcttatcatctatattccatataacattgatgatgtcatactagttggacatggtgaagaaggccgtgcatgtcagaggatgagcgagaagccctcagaagttctggagcctgccatatcagtgacattctcaggggtgcagcgtttgagggcaagccagggacaagttattgcatcctgcatccttacaaggaagaaagaggcacagcattgaggcacctctgtgttttggagtcagcatgcaccgcgctagaggatacctctctgacccctttattgggtaacgggaaaactgccagctttgagtggggcccagagaaaaagagggctctgctaaagatttggattgggagatgggcttccctgctgcatagatccaatgggttaccggggggcttatttggggtaggaaggaccctatatggcatctctggcaaactccaacggaagagttgcagtacactgtcctagagttcttggacaagaccatgccttctgcagcagagaactactcgccaagtgagagcagtatcaggcacactaccagacccaggtagagaccgagcacctgctggtgggacatcagcgaccatgcgacagggtctgcccaagcgaggtgttgtcagatcctccaagtcagtaggtcagaggctcagtagcaattgatggtacaatgaaaaaggaagccttgggcttggacccaagcgtgtctagtgggtaacagttatttacaggaagaggtggcagtgtggccccacatctgctttgcactgatatttctcccttagcagataagcattctggtctggttcgtatataggtcagtttgatgtgttgatatgaactgaaaatgaaccataggtacactacagtcccattcaaggtgaccctaaaggacgacaataggaaatcctccatggggctgagcttccagcagttcgtgtggatatccactttgtatggaggcagtggacagagtagtggcctgagggagggacgcatatggacttctgggttgtgacgtcctgctggctggtcagggacctgaaaagagcaagaggggaagatggacctacaggagtggccacacaatatgtgcatctctctgccttgtgttaatactgcagaggagttggtgaacagcaggatggatgggatgtcagtcagctgtgcccctggctacccctgtgcttgaacagtggactgtgagtggcggcgtcatgcagaaggagcacaggttagcgtccaccagcacaggccttctttctcaaggcttgtctcatgattactcctgctgaaagcgatcagtgctgagcccctgctgagataccatccctagagcaccccaactagttacttagtggcaagttggtgacagcccttcatccttgctggagttgacacctgctctggataagggtttgtcttctgtatccacagggtcccaggccagcatcactatccaggagcttcaggcatgctccgtgtaccaacatgggatcacgaatcacatcgcctcaggccaagaaagccattttatagcgaaagaggtatggtagtgtgtggatgaccatgggatccactgcttctctaatatcctgcgttacgtaaaagcagctaggctactggaaagatgggatgacttcttaagggcttagctgaggtcctggttctaggacagtatcctgaggagttgggatatatacactgaatcagagtctaatatatggtgctctgcccccagtagatacttcatgtggatccaagcagaaagacacaggtccaggaacccaagggttgggattagctacttctcaccatcattcccagtgcttacacgtagaatttgtacattctgtctccacagccttaggatctgctggattagagcctgtttcccaggtaggaacgcttccacgagggcactcctgctggttgcaggaaggatacctctgctgagcctgaatctgcaaagaccaccaggttactctcagctcctcatactggtggaccagcaggccacaaaggaggggatacttgatcctgataaacggtgaggaggtagcgtggctgctgcgtaacggggcaagcaggcattgatctggcacttagaggattcatctaggtctgtcttggtgcttccatgccaagtaatgacaatgaaaaggtcttttcagcagccatagcccctaagggctcagatgcctcagggtgaaggtctgggcagcgtcaccaggcaagccatggagacaagctggaatgctggtgagggtgaggccaaggaggaggtggctgctgaatatctgttacttgggagaagctgtggcagtggggattgtatttgttctgctaagcctcttgtattaaggctttcataggagttgtaactagcctttactttgaagaatcgtgacagagtagactcaatattgtagctgactagatctgagaggggcaggagatggtgtcttggctgatgccctcagcccacctttaactgcagtggacacagagctgcatctctgctgtgtgtctttgcacttcctgctccaggccttctctgacaccatggcggccccctgagcctgtgccgagattgtgccactgcactccagcctgagcaacagagctaaactccatctcaaaaaaaaaaaaaaaaaaaaaaaaaaaaggcgaggggaatacatacaggaatggactgtgaggatacaaagccaagaatgaattgtaggttagtgcaaatttatcaacatgagtgcacttcaaagagaatctttgattccgtattttggctcaaggcctgggagtagttatgaccgtgcctgggtggctgaatgaagcctggactccttggtggtttacattgatgggaagatgagaatgtggagtggatttgtgatgtatgtgacatgacctggctgccactctcctctctctatcccttcattagaccattgtgtaatttaaaaaaataggttataaatttcttttcaagatagtaaaggggtacgatcaacaacccatggaacgggagaaagtatttgcaaatcatgtatctgataaggagttaatatccaaaatgtataaggaacttacaaaactcaatagcaaaacaccaaataacccaatttaaaatgtgtaaaggacctgaatagacatttctcc

SEQ ID NO: 1237 - DNA, 165638 bp, Homo sapiens
ggctgaggcaggagaatcacttgagcctaggaggcggaggttgcagtgagccaagactgcgccactgtaccccagcctggacaacagagcaagactgcatctcaaaaaaaaaaaaaaaaaaaaaaaaaagccagccatgtggccatatgagggaggaggattccagaaagaacagtaggtgcaaaggccataaggcagtgtgtgccagctgtgttggcggcacagcaaggaggccagtgtggcctacagttgtagagatgaagtcacagagatgggggtgggatgtgggcgagaggatgatcgtacaaagtctgctatgtcattgtaatgggatggtgggcaggagaggatgattgtataaagtgtgctaggtcatggtaaagagattggtttttatttggaagcttttaaggagaggagcaacacattcaccttaactgctgtgttaagaacagactgtaggaagccatgggtggaagatgggagtcaatgaggaggctgctgcaatcatccaggcaagaaattgtcagtggctaccaccaggttgtaagaagaggccagattctgcatgcaattttaagacagtgacagtaggattcgtggatagtttgtatcagaatatgagaggaagagagctgtcaataatgacacgagggcttttgcctaagcaactggaaggatagaactgccattaattacatgattgagattgcaaagagcaggactggggagaaaaatcaggagttccactgtggagatgttaaatgtggatgtctaatagacttggcaagaagacagctgatgtacaagtctgtattttgggcaattggtccaggctggagataaaaatttgggctttgtcatcatgtggttgtacataacaaggagactgaataagatctccgagaagtgaaagaggctagcaaaaagaaaaggtccaagtactgagccctggatcctccaacattagaagtcatggagtgagaaggcacccactaagaagtgaaggagcagcctctgatactatccagagaagaaccttaaagtcaggcaaagaaagaattttagggaggagggagtgatcaactctgtccagtgttgctggtaggccaaaaaaatgagccctgaaaactgaccattgaaattcagtagcacaatttttttgctgttgttgtttgagacagggtctcactctgtcgcccaggctggagtgcagtggtgtgatctcagctcactgcagcctctacttcctaggttcaagtgattctcatgcctcagtctcctgagtagctgggattataggcaagcagcacaaaatttgctgctgaacttgacaagacagtttttgaagagaggaaggaggcaggagcctgactggacggagcttaagagagaatgaaaggagagaaattgcagctatcaaatacagacaactctttctaggtttttttctataaaaaggagcaaataagtaaagtgctagtaagagtaaaacataaagtcaacagaaatattttttaagattggagaaatagcagttatgccctattcctacatgatgatgggaataatttagtagaaagggaaagagtgatggcagaaagagagagaagaattgctcgaacaaggtctgggtaagctaggaggaacagattaagcagaggagctcctagctgcgtgggcttagtaacaggagggagggcagaatctgcaggtgcagatgaaggcaggttgggagctgtgatggggagtgaacgtgtggaagttctcttccgatgattcagtcttctcagtgaatagaaagcaaattattcaggtgagagtgaggctcagaaaggaggtattagagagttaagaagaaaaaggaaggcattaaatcatcaactaagaactgaagactgaattatagggagtacagaaaggccgacaggccacatgagatgtgcacctgagtttcccatgagaaagtggggatgaacatttgaaggtttactctgtccggggattatgtgacagtctttcatgccttctcttacttagccatcagtaccactttgaaaggtgggtgttctcccaagataatatcaagatgaagaaataatatccaagaaaaccttgggcaaggtctcagggtcaatcattggcaaaggtggaatgcaagctcatgcctgagtttaaactgctttctcctacataatctagaaaataaagataccagccaggagtggtggctcacgtctgtaaacccagcactttgggaggccaaggcaggcagatcacgagttcaggagatcgagaacatcttggccaacatggtgaaaccccgtctctactaaaaatacaaaaattagctgggtttgatggcacgtgcctgtaatcccagctactcgggaggctgaggcaggagaattgcttgaaccagggagttggaggttgcagtgagctgagatcacgccactgcactccagcctgctgacagagcgagactccatctcaaaataaaataaaataaaaaatataccacctctgtcctcttggaacttattttaataagataaataagacccataaatatcataggtaataatacataccataaacaaggtatagaaaatctgtgatggcagttgaggaagaaaaggtaacctgctgctggtgagtcctgacagggggaccatactagtgacctctaaatccaaaccagttgaggtacagagtacacctagctcataaatatttgttgaatgagtttatgaatgagaaagattagtactttcatttctcatttagtttaattcatgtttatatgaatgtatataaaatgtagttatttgttccagagcatgttatatgaagaaaggcctttcaatagaatgatatcttctaatagacttgatgctttgttggttataccagctgtaactggtatgtaaagagaatgttagcattatttaaacttcgagttgcaccgctgctattcatgctgcctcctaaacagaaatgatctatttcagtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggctttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacatacaacacttgccttattttgtttttttttggagtcaatgaactcttcgataacagagagtcttagggctttaaagtccacgatttaacagttattcattcaggatcccatcacttggtcgttttagccaaacttttaacccacaaattcaatttcctcaccctcaagactttctcttatatttgtccagccaataccttctccggctcactcatcctctcccaccacacccttgatatagatatagctgttaattttctctgttccaacatttaaactattgagaaaataaaaccttgctcactggtgaccacaaatttactctgtaccttcccctagactaggtatgctgttcagcatctgttttttttctgttttttaaaattgtgattaaaaacacataaaatttaccatcttcaccatttttaagggtacagttcggtagagttaggtacattcacattgttgtagagcagatctccacaactctttttctcttataaaaccaagattctatatccattatatagtaactccacattcccccatcccttcagtccctggcaaccaccattctgttttctgtcgcaatgaatttgactactctcagtacctcatataagtggaatcatacagtacctgtccttttgtgacttatttcacttagcataatgtcctcaaggttcattaatgttgtagcatgtgtcagaatttctttcctttttaaggaaaggaagaaattcattgtgtgtatatgcaattttgtttacattttgtttatccatttatctgtcgatagacattaggttgtgtattagtctgttcttacattgcaatatagaaatacctgagactgagtactttataaagaaaagagttttaattggctcatggttccgcagactgtatgagaagcatgatactggcatctgctcagcttctggggaggcccccaggaaactgacaattatggcagaagatgaagagggaagccaggcatgttttacatggcagaagcaggatcaagggagagaatggggaggtgccacacactagaacaacaccaaggggatggtgctaaaccattcatgaaggatccaccctcatgatccaatcacctcctaccaggtcccacctccaacaactgaggattacaattcgacatgagatttggatgggaacacagcatttttctgagccctccatatttttccaacctctgcctgttacccaattccaaagttgctgccgcattttcaggtatctttatagcaatgacccactcctgggtaccaattttctgtattagtttcttcccacattgctataaagaaatacctgagactggataatgtataaacaaaagaggttcaattggcttatggttccagggtctgtacaggaagcatgctgctgacttcttcctgccttctggggaggccttgggaaactcacaaccatggaggaaggcaaaggggaagcaaggcatctcatacggtgggagcaggaggaagagagagagggggcaggtgctacacacttttaaactactagatttggtgagaactcactccctacatggtaccaagctaatccattcatgagaaatccaccttcatgatccaatcacctcctagtaggcccctctccaacactggagattacaatttgacataatatttggatccaaaccatatcaggttgtttccatctctttactattgtgaatagtgcttccatgagcatgggtgtgcagatgtcttttcagacattgcctcaattcttttggatccatacccagaagtgggatgctcttcagcaccttttattcgtgtacagtcagcaacactttcatttccccacattgtctgttcactcacctcgagccatctactctattctacattcattcattcttccttctattaagggatgatgaaaacatccgaaggtaattctcttaacttcctctccctccaccttccatcctatctacatccactcacccttaccctcatgtctgtcttccacttttcacagcctatatctttcactcttcatccctttctgtcttttccaggacattgttccttcagttagcccctctctcatcattggctccttcgttccacctccaaaactcctgaagccaagacctgctgagctgcatgtgacagaaatccacctcacactggcttagaccaaaaatgaattttgctaaatcacatgacagaaaagtccaagcatgtagctggcttttgtcaaaacaggaatagtcaaagggtgccttcaggaatatcttctccttctgctttgcctggctggcttcattctctggaaaaaactccctaaaaactggcaaaatatttactgatgatgcaacatgcacgtctcatcagcttagccttccagtacaaagagcctctcgtccaataagtctttcaaaagtcccttcaatagctttcattctccaaatagggttacatgcccccaaaggaaacaataactaggagcaggacagtgaaataaacacagggcaaggcctgagttgcctgcccagccttggagatgggggtagggttggtctacctcattggttctcaggtgggatgattttgccctcccaaggacatttggcagtgtctagagacatttttggttactacaactgaaggacggaagggcttccagcctctagtaggtagaggccagggatactgccaaacatcctccaaggcaaaagacagccctccagaacaaagaattatctggtccacgatgtcaataatattgaggtcgagaaaccatagtcttccagaatcacactgaactatgggaaagaggggatttcccagtggaaaaatctaggggcaaatcccagaggaagggacccatttagagcaacagatatccaccttcacctccatctgaaaaaaatcttcccccaaaccatctatgtttctcgtttaaactacctctcttacaccaaattttctgaaagagtggttggccttagctgtctcaaccactgtagtcattcattcaagtgatgataattatggagctccttctgtgtgctaagcattattttaggtcatgggatttggcagtcgtaaactgacatgttctcatgcagcttttattctggtgggagagacacacaataagcagattttcagttggtaataaaatgaaaaaatgataagtataattttttaatctatatgaaacaggcaaaaaggaaaggaagttctgaattaatgtgcaattttaaatagtggccaaggaaggctccattaagaaggtctcatttgagccaaataactcaaggagatgaggtagtagccatgcagagcgatatctgggcaaagagcattctaagcaaaaggaatattaaatgggaggaaaaaactgaagagaaaaatacacctgctgcacttggagaaataatttgtttgcaagctgatggtaaaaatccagcagaaagaggtgtatgatagtgctggaggaagtgagaattgctggtttccttgagtgagtgagagcaaatcgaatctagggcacaagtggagagatcacccttagacttagactgtgaacagtataattatattaacaggagagacggaggtttcatgggccaaatacaagaatttgggtggagtgatggtagaaaattgtagatctatttgattgtttctattttctcaataaagaaagaaacaaagccattcacagaaattaagaatgttggagaaggtgtcagaaataaatgtcaaaataaaaatatgaaatagtcatttaggagaatgggagaataaatggattagacaaacaatagtgggaatgtcaggcagaagtataatggtccatttgaaattatttgttactaaagtaaggctagtcattgtggctatgtgtcttttccagccacattcagtttcacaggtatgagagcaaaataatggagaattgattctaaccaggaatgttgttttgtctaatggctataataacccaagagaagggtgagggagctaacagtgggtgcaagatggtgattataatgacagagtatggaatttaacctggtagtgatgaaagtgaagacacaaaggaggtgagaagctgagagagatagcggtaggatcaatgggctgcaggcactgagacagacaaagattgctggattcagtttaacgttactagggtaaaagaaaagagttggattggtggttagagagtgggatcattgaaatcactgagaggttgaaagtgacaagtctccgagcatgcacatgagcattagagtcagaggagagtggaggacaagaccacaggcagagaagaggtcaaggcactggaaggccagggatttgaaaatactattgctgtgaatgttgaaatcaccaggaactgtggcagaagtaacagtggagaaggtggccatgagccaggagctcaaactttcaaggaatgagggagaaagtagatactaggagatggataccagcagaagtggtaaggagtggcaccttctgatagcatgtgatgtaaaactggggaaatgagccttctcctcttctcttttcctaagcctactacaatctggctgctactcccattactctgttgagaataacttgaaatgatgatagcaaatccttaaaagaatgtcactggatgtactaaaaactgtgataagtgatatgatcaaagtagacatttcttccactagaattttgggaggaagcctaatggaaaccaatgcgcacagaaagacaaatgctgtatgttattagtcatatgtggactctaaaaaactcatctcatagaagtagagggtagaatactggttaccagaggctggggaagggagagacaatgggagatggagagagattggttaaagggcacaggatcacagatagataggaggaatacattcatccttgaatacttaaccctctgccctaaatctgtcagtcctacatccatacttcttatttcagtaagtagcaccaccattcatttctaatcctggggctaactcttttttttttttcttttctgaatcatgtctccttttaatggttaaggaaaacaagtttaacataaaattagcaacaacaacaacaacaacaacaaaatcaaggtttaaagtcaaaattattttaagagaaaaacccaggcaaaatagcctacctacaggcaggcagtacatgtcagaaggacaggccacccccaataaaaaagataaaatattattttttctaccttttttaaacttaattatttaattatttctttcttttttcttttttttgtttcttttttttattatactttaagttttagggtacatgtgcacaacgtgcaggtttgttacatatgcatacatgtgcgacgttggtgtgctgcacccattaactcgtcctttacattaggtatatctcctaatgctatccctcccccctccccccaccccacaacaggccccggtgtgtgatgttcctcttcctgtgtccatgtgttctcattgtggaagctggaaaccatcattctcagcaaactaccgcaagggggctaactcttgattgctttcttctcaccaccaaccttaagaaaggaagtaaccaaaatccaatacatgagcaactgttcattccatctccaatatctttgttaattgtccactttatccacccagtcagggccgccatcaaacctcacttggatgtcggcaaaagctcccctgactggtcttcgcagtccattattgccctattctaatctaccttccatactatacacagatttacattttttaaatgtgtatctaattgtccctcccttttaaaaaatcttacaatggcatgacgtctcaattcagggtaaggaaattgtttcttcacattccctgtacaccgtacacatcgcctgcaattgcccttcaacacggagagcaggcatttcattagctgaccttcccacacacattcttgcaaagaggaaaagttaagcagggtgtttggaggcgagctgccatcatccaccgcctttgtctggaagcgcagggcctcacacgcgggatccatcggaagcccgagcattgtcaagctctgctgctgcacctgggtcagcaaggtgggctctgccagcgaaactcgttagaaacaatgcaaatggggagtaaacatgacctcgcccatgaaggggaagctgtggtcaaaagcattttgtcccggaaccccgcagccctccccacactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtgagaggcgggcgggcgtggggaggcgcccgggcggacgaggaacccggggccccgcagagaactcgcgtgcagcgctgagctgcgctgctctgcgcgcccgggtccgaaggcagcgcgatgggtgggctgagcgcgcgacccggcagggcggcgggtgtaggatccttctgcgcactggagaccctcgctgcttctgggtaagcgtggagttcccaggtgcaggggcttaagtcgtgacgagcgcagtggaaggcgcagatgctgagcgggtgccgcacgaaattccttgcctttgtgtattcacagcctcggctggctatagccaagacgtggcgttgatcctagtgaaagggaacttggggatccgacaaacctgagttctggtcctagaaacttaactgtgaggcaacttagcacacctgagtctgtttgctcttctgtaaaatggggacactggtatctctgcatcgtggagttgctgcctcagtggcattaagcctgtcgagtatctaacacagggctatgtgtccccgagtccatttctatcccccaaccgttacctctgtactttgctcccaatggtgtttagacaagcagtcctagggatgcaggtgttacctgacaactgccccgcatggaactgtcctcgccccccacaccaagccaccacggccatcatcaccatgcacttaattgacagcatactttaagacagatgcatgccaggcacttgcggattagaagagcaagggaagccccagaacatgcaatgtaaccgttgcaggtagaagggacagtagatatgtttacagttcgcattttagtgatgtgtttagtacaaaataacgcctattataattattatggaaattttgaggccacatctcttcctttttcttaacttcaaataggtaaacatcttcagttagaacccttctattattatttttcggctccccagaagtcttcttggttgcctagactcactggcaacatctcatttgaagtgacagtcttggttgtttttgtccagcctattcctgacaactccgggttcgcccttctctgccactagacattttacattcattatttgagtgttccttcttctctaaaagagtaaataaaataaaataaagtagaaccaagtcccgcaagagttgttattaatatttgatctccttaggcaccagaaagtaacctgtcaggtgcagagatgtgataaaacgtacaatcttatttttaggagagaagcatgcccagtaagttaagcaatctgttgtcaacgcttaggaatttgtgtcatctttgggagtactggccctcttcttactagaatgttgttttacttagcctatgttgattaagttactgttataaacaatcccagacactattaattgcaaaaaaaaaatttactgaggttatcacaataacttccaaatgtgaaacagcctaaactaaactacctagaaattttgttgctgacataatttaaattttaaaatgctgatggatgcttccagtgtgcacggtcctttggaattttaaagaagtataagagctctgcacccaaagtgtatgcatatagaagtaggtggtggagttttatgaaatctacttattaggaagccagcgttctgctttttccagcctctgctacttaccagctggtgtcttggacccagtaagttaagtcacatcactgaccttcagtgtccacatgtataaaatgagcacaactgacatcctgatctctgagagagacgttttgaaaatcagatggtgtaatgcatgtgacagtgttttgtaatctgaaaacccccatgcatgtctgaaaaaccatgactaagaagtcgtgcaagactgcaggatcaccgaaaagcgagaaatctcaactcctatgatcaggaaaggatgagtgaaaggtatatggctttactagcacttaaagagtgaatctagaaacagattgcatacgacaaaaaatagcagaggagctaggattgttttgttattatgagttactcacagtacccgtaaagtggtatagtgctatttgaaagaggacttagattagctgcaaatagatattgcaaatgtaggacaacccctgaaaaatgtgaaaaaaagaactataatttatatgttaataagtaagagagaattgcatcatataaaatgctcagttaaaacaataaagatggctggggacagtggctcatgcccataatcccagcactttgggaggctgaggtgggtggatcacctcaagtcaggagttcaagaccagcctggccaacatagtgaaaccctgtctctacaaaaacacaaaaattaccagggcatgatggtgggtgcctgtagtcccagctactcgggaggctgaggcatgagaatcgcttgaacctgggaggcggaggttgcagtgagtcgagatcgtgccattgcactccagcctgggtgacagagcgcaactccaaatcaaaaaaaaaaaaaaaagaaacaaacaaacaaaacaaaaaacaataaagggcaggaaaagaatggaagacaaaaaatagaaacagagaacaagagaaaaaaagcaacaaataaaaaccagtaacaaaactaaagcaactatatcaacaatcattttgagtgtcaatgatcgaaatgcaccatttgaaacagatcatcagagtggatcaagaaacaagacccaactatatactgtgtacaacaagaccgttttaaatatagacaatatatatgaaaagtaaatggataaagatataccatgctaatgctagtcacagaaagcaggaatagctgtgttaatttcaaacacagcagacttcagaccaagaaaaattattagggataaagaggggcatcatataatgataaaggggccaattatccaagaagacgtaacaatatcccatatgtatgcacctgatggagagacaaaatacgtgaggcaaaacccatagaactgcaaggagaaatagatggatttactatcatagttggagacttctatgatatctttctgatatcagaaaaggtgctgaagtctccttatcagaaatgggcagattcagcaggcagaaaatccgtaaggacatacttgaattcaacagcaccatcaatccacttgggtataattgacatatatagatgacttcatccacaacagcagagcacatattctcccgcttacattcatggggatagaccacattctgagccataaaatagtacacgaattaagctttaccaggcagtgtttaatatagggtggactctggcgccctcacgtggtcctcatataggatctggtttggttatccctgctaggtaaaggtgcaagatagaagggaagttccaatttgctttctgtgctttgtggtgtattttggtttacatatgctcagatgagtggatgtgtgatttatattatctattttaatctaaaataagcttcacatttggacaggtaacatcaaaagtgtcctacacagaaatgctgggtgaagatcccagtaataaaaccaactccagaaaacaagaaaatggtagagttgacaatccctctcaccctctccgcaaagacacatgtatacacattttttgtcagaggcattaagtagaagaaatgctgtcagtctaatcacaactgatcacaactcgatgaaaccaaaaaacctagaaagtatcatgaagactgtcgaaataagctttacattcactattgtgaacagagagactcaatgtgactgttttttgtcccgttagatgttagctaatgattgtgctaagtcatgatgattaacaaagcatttaaaatatttattttatctgtgttacatttcaaaaatttatattgaggcatataatttatgttcgtgtacatatataatttataaatttatatatttgaaagggcatgctctttttttaaactgatagaggtgcctaagcaaagcaagtgcaaatctattccttaaagggtaagtatgcagaatggaaagcagagtgttctttgggttgacagctcatattgcaacagacatgaaagtgatgatgtgttaattgtgcatatagcacagaatacatcaacttgctttgaatggaatatctgaaccaggagaatgtgaaagtgggctgagtcatacaagacaaaacccgaaatgagataacaatacatacccactagaatgactaaaatgaaaaagattgaccgagccaagtgttggcgataaggtggagtaactggaattataatatactgctatttggcaggtaaaattataacattaactttagaaaatagttcaacagattcttaaaaccttagacacacactcaacattttactcttaggtttttacccaagagaaatgaaatcatatgtccacacaaagacttgtacatgaattttcatagcagttttgtttgtaatagccaacacgtggaaacaatccaaatgtccctcaacaagtaaatggataaactaaattaagatatatttatgcaattgaatattacccagcaactaaaggaaacaatttgtatacatgcagcaacctagatggatctctaattatgctgtgtgaaggctaaaccataaaaaaaaacctgagtgatttcctttatacaataggatataaatgaagtgatttaggttatatgaaattttagaaagtcaaatcaatctgtagtaagagaaaaccacctgagttatttcctttatatgataggatataaacgaagtgattcgggttatatgaaattttagaaagtcagatcaatctgtagtaagagaaaacacattgaaggttgcctagagaaggaagtggatgtttggatggattacagaagggcatgagggaactctgtgtgggtgggatgtatgatggaaacgtttattgtcttcattttggtgatggtttcacaacgcatacatatgttataagtaatcgaattgtacacttcaaatactcatcaatcattgtatgtaatatatcttgataaagctataaaaacttttaaaattatggtaggtcttcagtttgtggattttatattaatatatttgtcataggaactagtcacaattgagggattggtaataaaggagagaaaggaaactacatcaagctttctttgttgaaggctcatatattccttttttgagctattatacaactttgctttttataattacctatactattcatatactactatgcaggtaagaatattatgtaattaaggggaaggaacttctttccaagaatggttcattcaatttgctttgttactttaggtctcattccttcctctcgttgcaagctttgctgtgacatttaccctctctcaatacagcttttggcgctaggcacttcacatggaatctcttcctttgtccggcatcaatggataagacaaatatcaaaattgtatttcatcccacatatcaactagaggaaaggtgaatgcataacactgaaaataacagcaactgttttactcagtgttttttttttttacagtatcctcaaagtgctgttatctatcaaaatcagctgtgaaaatttttaaaaatagactcctgggccctaacctagacccactaaatcagagatttgggggacatagcttggattcttgatttttttgagttttataagtaattcttcattttttgttcattgcaacaaatatgcattgagttcttataattgagtgttaagcaccaggactaagtattaatttagaggtacaaaaaaacacatcatctcttgcctttaaattatgcatatctaatatctattgagagaaatagatacttctaaaagcacacaaagataaaaagcacaaattgtaataacaaacaattattgatatgaaaggaaaagcaaagtgtcggactagaaattattatagggtggggcagagggaagtagtttagattccaaatccctaagagggtcagggaaggcttcagatgagattgggtgtgttcagggtggtatggccataggcaggctggggaaggcttctataagaaagtgacattttagcagatgcctgaaggaagaattgaagtcagagtgaagataaaattgcgtcacatagaaggaatgtcatagacgggaaaaatgtgtgtctttgggaaactgaaaaaggggaaagggccacaccttggtgaggggaccaagtggcacaagatgaggcagggaacatagacaagggcttccttgcttaacaactgctggcttaataaagcaaatgtgtgatgatggatacaggctgtctgggaaaaataagtaagaaatatgagctttcttggagcatcatcctttgcttcagtagaaagcacagagttaggcttccaattctgactaaagccattgacaacagggaaaaggcaaccttaggaattctcctctctgtccggggtcccgtgggcactatgatggagctcatgagatgcagatgagaagtcccaggctgaatccggggcacattcactcaggagagctgaggtcaccagtcactgaggtcatccagtgcattcccgacagcataggctcattccaagctagttctgcaaaggagcagaaaatgaactcttggaagcaaagcaagcactcccactttagcggaataatcgaatttaactcttagaagtccccttacccttttctaagggtaataatcgtaagtataatttatgaagtgccttctgtgtatgtggcagcatatactacttttgattctccctgcaaacctggtaggaaaatattattccctttatgaagatgaaactgaggctcagcaagattaagcggtttgcctaagacctcatagccactaagtagaagacattgggttcaagattcaatctatgaacccaacatttttaatactatataccattctctttttgtattaatttcctattgctgctgtaacaaatttccacaaacttagtggcttaagacaacagaaatgtattctcttccagttctggaggctgacgtctaaaatagatccatagggctgtgttccttgtggaggctccaggggagcaggggttttcttgctctttccagcttccaggggctgcttccgtcctttggctcttggcctccttcctctaccttccaaaccagcaccatagtgtctctgaatatccttcttctgtctcctttcaccctcttgcctcccttttataaggacccttgtgatcacatttaaggtccacctagataacccaggataatctgcccatctcaagattcttaatcacatctgcaaagccctttaaccattacaggtaacaatcacaggcttcagggatcagaacatggatatctctgagaggtccttacttagcctaccacacctttccatatagattctcaaaattttagctgagcctaataagggagttcattaccattagggtccggtttagtagcaagtgcttcctttaagtgaaaaggtgaaagttgtccacttaataaggaaagaaaaacattgtatgttgaagttgctaagacctaaggtaagaaggaatcttctatcgatgaaattgtgaagaaggaaaaataaatttgtgctagttttgctgtcacacttcaaactgcaaaagttacaaccacagtgcatgctaagtgcttagctaagaggggaaaggcattaaatttgtgggcggaagaggtgaacagaaatgtgttctaattgacagctgtcaggtttggtactatctgaggttttgggtatcggctaatgtcttggaacatgtcccccaaagataagtgggtgactactgtatattcaaaataagcatttatatactggggagtaaatctcccatgttatttgtgttttatttgtcccacaaataaagtaaacaaagtagaattttaggcaagattcatttctagaggcagagatattttattataataaagaaggttgctctaccataaaatatagcaatttaaatttttataatcctaataacctcaaaatatataaaataaaagatggacaacattataaaaagaaatagacaaatgtacaataaataaaatattttaacacaactcattatctagtaagacaagtactccccccaaaatcagtaaagtatctagaagatttgaataaatattaacagattggattcactgaccttgttacaagaaagaattatacatgatgataggagagaggaagccacagcacaggcacttactgattaactaaattttgaagctgtgaaatgcaccttatcctttagtgaaagatgatataaatagcttagttgccttcaaactggcagagactttttgaatggatggatgctgattttttaaaaaggagcccatttctgaggcatcttttaaagcaggggtcctcaacccctgggccatagactgatactgtccagtggcctgttaggaaatgggcagaacagtaggaggtgagcagccaagcattactgcctgagctccacctcctgtcagattagtggcagcattagattctcataggagcagaaaccctattgtgaactgtgcatatgagggatctaggttgcatgctccctatgagaatctaatgactgatgatctgagtggaacagttccatctcaaaaccatttccctgcaccctccattcacggaaaaattgtcttccacaaaaccagtcccaggtgctaaaaagggactactgttgtaaaggaataagtccctttgctattattatttttattaagatggaatcttgctctgtcacccaggctggagtgcagtggcacagtcttggctcactgcaacatctgcctcctgggttcaagcaattctcctgcctcagcctcccaagtagctgtgcacaggcatgtgtacaggcaagtgcaatcatgctctgctaactttttgtattttgggagaggcagtgtttcaccatgttggccagcctggtctcaaactcctgacctcaagtgatccacccaccttggcctctgaaagtgctgaaattacaggcatgagccaccactcctgcaccccttggctattattgaagtgttctttttcttttttgatcacatctatgaagtatattggagagaaagagaaggtagaatgggaatttcaacagggtcacggtggctcactcctgtaatcccaacactttgggaggccaaagtgggtagatgacctgaggtcaggagtcgagaccagcctggccaacatggtaaaaccccatctctactaaaaatacgaaaattagccaggtgtggtggtgggcacctgtaatcccagctactcaggaagctgaggtaaggacaattgcttgaacccaagaggcggaggttgcagtgagccaagatagcgccactgcactccagcctgggtgatggagccagtctccgtctcaaaaaagaaaaaaaaaagtatggtaatttctccattaactttgatgcttctatggtcttgatctccaggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaagtaactctggagtgggaacccccctgttagtcaaacatctgtaagatctgattcaatttgttcaaattttgtaactgagttgcatatgacaattagtttgccaaggtgcaatacatatgagaattattcttgtagatcataccttgttactgctttgagttcctggcgccttcattaaaagtttatttcatgagaaacagtcattgcaggacatgattgagggaaaatccccattcactgggggtctcccattttcatgactaaaattaagtaatgaatgacttgggacaagaaagagaagtggattaaataactaaaagatgtgacaatcttgggctttgagatctttggattataccagttgaattgaattacagataataacaaagtttacatttttctgggaggcataatatggggatgaaacagatctgaaaggaaagttttttttgaaagggagctgatcctgaggcagtctggtgagtttcctcaaggtagcaaaatctgtggaaccatcagaactgcgtgtgttcctcagtaagctacaggcaggttgagaccttatgtactaaaaaaagtttttagtttactctacttggctccaaaattctgtttctttcctgtaggtaaatcatgtcgtaatcctccagatcctgtgaatggcatggtgcatgtgatcaaaggcatccagttcggatcccaaattaaatattcttgtactaaagggtgagttggcatctcttgaaccaacatctcttggttcaagagttctaacacagccttactaccttctagtcacatgtcagaaaggacaactaaactattaccatctgctctttaacggcttcaacacagatgtttagctcctgactgaaatgagcaaaggtatgacaagatcgggggaaaatcatctgtatccttgctggaaaccaaggcagagcatatatgaaaagtgtggcattcattgggtgggaaggaagaaaatgggggaagagtatagtcaaagcacacaaacagccttaacgcagaggggacattgctggaagaaagggaaggccattgagtaactgtgtgagagaaatcttaacggtcatagcacaagtagtttgctagggctgctgtaacagagtactccaaaacgggtggcttaacacaaatgaagtttttaaaattctgttccggaggctgaaagtgcaaaatcaaggtgttggcagagccatgctcccctctaaaacctgtaaggatggatccttctttgcttcttccagcttctggagccccaggccttccttggcgtgtggcagcagaactcccgtttctgtctctgtcctcacatggccgtcttccctctgggtctgtgtcctcacatgctgttttcctgtctgtgtatggctgtgtcgaaagtgctctcttttaataaggacaccaatcataatggattagcgcccacactaacgacctcatcttaactggattgcctctccaaagaccatatttccaaataagatcacattaataagcactggggattaagacatcaatatatttcggggtaagggggacacaattctcattcattgctggtaggaatgcaaaatggtaccatgacttggaaagataatttggcagttttttataaaactaaacatactcttaccatgttatccagcagttatccttcttggcatttatccaaaggaattgaaaactcatgttcacaccaaaaaaaaaagaaatctgcacacagatgtttataacagctttattcataattgccaaaacttggaagcaatcaagatgtcctttagcaagggaatggataaactgtggtacatccatacaatagaatattattcaataccaaaaagaaatgagctatcaagccatgaagagacatagaggaaccttaaatagtgaaccttttttcaccatcactaagtgaaagaagccaatctgaaaaggctacataacatatgattccaactatatgccattctggaaaaggcaaaactatggagacagtgaaaatatcagtggttgtcaggggttagggaagaaggggatgaatcggaagagcacagaggattttgagggtagtgaaactactctgtatgatgccataacagtaggtacatgtcataataaatttatccgaagtcatatagtgtacaataccaagagtggaccctaacataaactatggacttggggtggccatgatgtgtcagtgtaggttcctcaattgcgaaaaacgtaccaccctggtgaaagatgtttataataggggaggttatccatgtataggggcagggagtacataggaaatctctgtatcttctgttcattattgctgtgaaccaaaaactgtgctaaaacacaaagtctattttttaaaactgcatagacataaatacatgggcatatgtgcataaacagacacgcacacaaataagtgcaggtaaaacaggaaatttgaacaaaatctgtggattataactgtttcaatatcttaatgttgatgttgcactattgttttgcaaaatgttattattaggggaaaattgagtaaatagtacctgggatctctctgtactattccctgcatgtgaatctgattatctcaaagtaaaaagttttttttttttttaaagttcctactaaatttccaaggggatgggcttcccctcagatcactaccccttttcagggagcaataaagtaatcttccttggaatgtagcaatctgtaaccaatcaaaatgctgtaactatgcatggtcccatatggaaaatataatcctgctaaaatttctctgtctctgcctatgtaagtgataccttatgtcctccactttggagtgctgaccccattcatttggagttggtctcttccaggtggctacccttaacctttgtgctcaaataaactctatccttaaatatattttctgaatctcattatttaaggttgaaaatgtgctaacctaaataattcacaggatttgttttttattctcattttttcctaacctatccacctggttcaaggcacatagattaagaaggaaaatggaaatgggactaatatcccaggcttcactgtccctcttcggggccctggggaggagactcccaaaagtctagacatgttcacccacatcctgtatgtggtttctggaaacgaaatgatcatggcttttcctgaaccatggcttaactttgtgaatccacaactctctcttccccaggagatccaaaaaggtagggtaggatgtaaaggcttcaatctgttcaagtggatatgagactccctggctccccttacaataagtagcatggattttgtctctctgccttacttcctccaaacattctgaatgagaagtgttcaaaccactatttgttcaattgcttaatctactttgggacacaagtttaataaattaaaatattcttctatctgttccccttgatcagtgaacataaagttatcttttgactcatatttaaaatgttcagtattacaacactgaacaatagtatggaggaaaaaaaatgccaacttaagtttgaacttgcttcaccattcctatcccaacccccatgattagaaaatcaaaaagaacactttgagaaataacctcagtggggtcaaaagccagaggagcctccaggatcccttgttcctaagacaaacaggcaggaggaggtgcacatataggattgcagctgttcttcacttcatttgttcacatacttcatacttgtgtttatgtctgttggcagtgcaatagaaaatgatttcatttttggtggtatactagaaggcattaaaaaacaaaataaggccgggtgtgctggctgtaatcccagcactttgggaggctgaggtgggtggattacctgaagtcaggaattcaagaccagcctggtcaatgtggtgaagcctgtttctactaaaaatgcaaaaatcagccgagtgtggtggcaggcacctgtagtcccagcagctaaggaggctgaggcaggagaatctcttgaatccgggaggtggaggttgcagtgagccaagatcgcaccattgcactccagccttggcgacaagagtgaaaatctgtctcaaaaaaaaagaacaacaacaacagcaacaacaaaaatcccaaatgatattgaagtcattaataattacatcataatcactagtataatgtaatagtgcatcaagtatcttcaaaagcacccactgttctctcactatttatttgatcttcatttgtcactgttttgttgtttgaataaagctttatgttgccaggttttcttacatactcataaagcaaagttctcagctataccaataaccatgactgttatttgacattgcttcattccttcatgtatagtactatcaagtttgaccctaccctcactatgactagtttcacccaaccatctatcacaacagagagtctaacgtgaagtaaaataaatgtcataaattattccaaatttatggcacactgtgaacagtttgagacatactaattgagaattgctgactttagtattttaagtataaaatgagtgttcaattctttttgatcagcctggatttcctttggttctagttatgtatccccttccttccttccttccttctttccttccttccttccttcctccctcccttccttcctttccttctttccttctttgctttctttctttcctttttactttcttttttttttttgatacaatgtcttgctttgttgcccaggctggagtgcagtggcatgatcagcactcactgcagcctcaacctccctgactcaagcgatcttcatgcctcagcctcctgagtagctaggactacaggaatgtgccaccacgcctggcttttttataaattttttgtacagacagcttctcactatattgcccaggctggtctcgaactcctgagctcaagcaatcctcttgcctcagccccccaaagtgctggaattacaggggtgagccactgtgaagggcctaatttggccttctttaatgaatcttattgataaaagcccatccatgcatccatgcatccatacttttaaggcaaagaaatacatacaacaggactgtatacacacatatacatgtatatatatgacagcttccctgcactcaagaactttgtgctatcttttaaaaaatgaaatttataggaaaaactacaattcatcttagatttgcataaaaaagtgtcataaggtaataaagaagagaaagctcatccaattgagaatgtatgaaaaagaaagtcaaaaagtcccaagaagaatgtgaaacttgggaaagtgatagatagtcctttgatgagtgtaaaaagtccctctgaatcctataagagtgtaatctctggaagtagtaatttaattgggtagttgacctgtgtctttagaatgtaacattccttattttttgcctctagataccgactcattggttcctcgtctgccacatgcatcatctcaggtgatactgtcatttgggataatgaaacacctatttgtgacagtgagttgaaatatcccttcctatttcttttaccgacacattctaatttttctctggaataataaaaatcttaactgaattccttctgtgcaatctgtccttcacacggctgaagactgcggtaatgttctcgaatattcctatggggttcctggcaactctttctttaagttcttccttatcctgggatgtgtcttttctaattccagaagtttaaatacataaaagccttcaaacttgattttacttcaataaacgtgaaattatgttgtttctaccacctccagtataataatcatcttgcttggcaaatcagtaaagatttttaaaattgatactcttcaaggttagcgaagctgtggaagaacctggactctcatgtaccacgagatcaacacatcctcttgaaaggccccatgcactataaacctcagaagtgaacatatattttaacctacttcttaaaatttatacttaggaaataatcacacactttttaaagtagtttggtataaacttttcattgcagcattatttatattagttaaaatgttagagtaacctaaatattttaaactatggtttggaaataatctactagtaggaaaaagatgtgttcaaatgaccattataaagaattccctaagaaacataaaacagctatgcagaatgaaaataagtatatccatacactggcatggtattcagccataaaaaatgacagcataaagaagcacttaatgactagaaagagatgtattttatgtggaaaaagaatcagatgaatggcatatatggcaagatctcactttattaaaaaataatacacctatgtagtgagggccaggctgaggctgagagaaatacagtgtataacatctttgtcttactcttctctttggataactggactcctttacttttcttcttggtatttaaaaatgttacttttactagaaagtttaagagcttcagaatctaagtttacaaatgacattggtcacacatttattgctgtttatccactttaagaaacagttttgctattttgtaaaacaaattgggaaaccttccatcttatttgaaatctgtaataaacatggaattggaataggaattttcctggaaatatgaaaaagattagtaaaatagagaaaacaaaaaatataataatacacctatacctgtatttattttttatctctgtttctacttctgtaacctctctgtatccaaatcctggtaaatggcctcaagtcttcttggaaaaggctaggggaagatttacaatacatgcttttgattgtgtagcatggtgcttcctcaagagaatccagtctcccatccgttggtgctgctctgggtctataaactattcaagtctaggaattgttgatgaacaatgaacttcttttgcaataattcaagtcagacttctattcacttgacctaaaactcttacacttatacaaatcaagtaacactttagtcggctatccgtctactttggttttagagactccatgatcaattagcccaataacaatgtcctcttcaatcaaatcattctgattgctgtttcagctcaaatatgcattacaagaacccccattgtctctggcaattaagtgctgccactgggactctgccaccctgaggtcctttggtccccaagtgaattcagagaatccagttcaatggcaacagttcccattgtcattcctggcctacagagaatgaaccgttgcagaggatgctgaaactccccatgtgaatgtatttctcaagcctctggtaaaaggtctgtcttctgaaccctctactcctgcactgtgcctcaccagctctatccaaggatacaactttcagagtggaatggctgttgcttaacttctgcctctcaaatatcaggctaatttctcatgctataaccctagtccagaaccgtacagagaaagtaagtctggaaaacttaattccaaattggcctggttgacatggtgccaaaccaccaaataattataattttatttaactctttgtcttcttttctttctttccttccctccctccctcctttcctccctccctccctccctccctccctcccttccttccttccttccttctttccttccttccttccttccttccctctttccttattttctttcttctttaccacgctggctaggaccaccagtataacattgaacattggtagcaatagatgtcatccttgtcttgttccacatctcaaagttaaagtttaaaacatttcaccattaagctggtgtttactgtaggcttttggtagataaccatttttgaaataaggaaattatcttatatattcttcattgctaaaaaatttatgtctttgaatcatgttgaagtttatcaaacactttagttacatatattgatgtaatcatatctgtttctctttttctgttaatgcaacaaattgttttgagtacatttttgaaaggcaaatgattttaaatttcaattttacattcttaaaataaatcaactcagtcataatatttaatcatttttatatatggcaaatatgcttttatgatatattttagatgtttctattaaaatataattcatgtatcataaaagttacctttttaaattatacaatttagtggtgtttagtatattcacaaagttgtgtgttatggtctgaacgtttgagtccaccccaaatccatatgttgaaatccttacccctaaagtgatgacattaggaagtgaggcctttgaaagatgattagggcatgagagcagagccatcacgaatgggattagcgtcctaataaaagaggcccggaagagctcctttggccctcccaccatgggaggagatgctgaatctgccagtgttggtcttgaactccccagcctccaaaactacaagaaataaatttctgttgtgtacaagctaaccagtttatagtattttgttatagcagcccaaatagactaagacattgggcaaccagcaccgccaattaattctagaacactttcatcatcccattcctaacatattttagagataagactataattttctttcttgtaatgtccttaataagattttgatatcaaagctatgacagtcttataaagccagctggtagtgtttcatatatttgtttccttgtaagggtttatataagattggcattatttcttctttaaaaataattcaccagaaaaggtatgtggcctggagtttacgttcttgggaagtttttttttttccaaccattttcctgtaccatgtagacttttggctgaagtataacatatatatatatatacacacacacacacacacacacacacacacacatatatacatatatacttatatgtatatatgtatatatacgtatatacgtatgcatacgtgtatgtatatgtgtatatatgtacgtatatatacatacgtacgtatatatacgtgtatacgtatatatacatatacatatataggtatatacatatatacgtatatatacatatacatatataggtatatacatatatatacgtatatatacatatacatatataggtatatacgtatacgtatacatatataggtatatgtatacatatatacacactatatatatatacacatatatatagtgtgtatatatgcacacatcttaatcatgcagttcaatggagttttacaaagtaaatgtatccatgtaaacgtcactcagattaagatatagaacattatcagcaccccagaagccttcccgatgccctttcccagttatcttcccaaagaaaccactattctgatttataacactaatagttttgttgcttcctaaattttatattaaaggaatcaaaaaatagatactcttttgtgtccagcttcatctcaatgttatatttggaagagtcatttttgtttttgcaggaaggattgttgggtcttctttattattatgttgtatttcattgatgatcttgagtaccttttcacgtttgtgaagtgctattccaaacttttgcctattatttattagtttgtctattgttttgtagaagttctttaaatattctcatgttttctaataaatgtaacacaaatattgtctttcaggctgtggcttttcttttttccttcttaatgatgtcttttgtttatgaaagttctacattttaataatattcaatttaggagtcttcttttttccagttactgctttttctattctacttaagcaattgggccaagtgaggtggctcatgtctataatcccagcattttggaaggccaaggcaggaggattgcttgaagccaggagttcaagaccagcctgggcagcagagtgagaccctgtctctacaaaaaaaataaatatataaaattagctgggctcagtggcacatgcctgtagtcccagctacttgggaggctgaggtgggaggatcccttgagcacagaggttcaaggcttcagtgagttatgatggtgccactgcactccagcctaggtgacaaagccctgtttcttatggatgggcaatagatctaatatcatctattaaaaagactattccttgcatagtgcaatgcgacaccaccatgaccataagtcaggtgaccttatgagtggatctcattccagagaggttctgtttcactggtttatttgccatactataagcactacattaagattttaattactatagcattacattaagatttgatatctggtagcatatatctcctaactatgtgcatcttcaagatttacttggtgattcttggccctttgcattaccatataaaatttagaatcagcttgtcaatttccacataaagaatcctacttgaatttgtattaagtttctgttgactcagtagatcaatttgtggacaagtaacaaatttacagttttgaagtttaaatttatgaatatgatatatcctcccattttgaagtcttctttaatttcttttaataatatttgttaatgtacattatagaagtcatgtacctatttcattatctttattctgacatattatttttaaaatttcattctttaattatttacttcttagatatgcacctgtttcatctcagctccagcaaatttgttaaatttacttataaattgaatagtttatctgtagattcttttgaatttgctgtgtaattatgtcatctatgaatctgacaaagtttttacatcttttcctttcttatgtcttttgtttatttctcttgctttattgcattggctagaacctccagtacaatattgaatagaagacatgatacaaggcttttaatagtcctcataaatcatgatgtatgctgtagatttttgcatgatatcctttattagattaaggaaactcccctttctttctaattactaaaagatttatgaatgttctttctaattgatcactgcatgtattgagattatcatgtttctttttcactctgttaatgtaatatattacattgattgatgtttaaaagacaaacgctgaattcctagaataaacctatgttgcttgtgatgtgttatagatgattatcctatgtatgggggatatgcgtgtgtgtgtgtgcaggattgctcatatttttattgtaacattgtaacattgatttaatatttaaaatcagtcaaggtaaacctcactttgatcattgtatcatcctttggaaatattgctggattcagtttcataatattttgttcagaaaatttgcatttatattctcaagagatcttgggttataatttgcttttattttaatgtccttatcaggtttgggcatcaagattatgttggcctgataaaatgtgttaaaaattatttattttttctagtgtctggaacaatttgtgtaacattatttttccttatatgtttggaagaattcagcagtgaagcaatctggacctgagggtttgttgttgttgttgtcaggatttaatatctttaatagctgtaaaactattattttatatcttattgaattagtttgggtaagttatatttttcaaggaatttactcattttatttagatttcctaggttatcagcataatgctgtttattatagtctcatattagcctttggatgcctgtaagttctgtagtgatacccttacactcattaatttctgatattggtaatttcttttgcttctttttccttgattagttttaccggggctttatcaattttactaagcttttcagaaaaacaacttttaactttcttgttttttctttagtttatgactattttctcttttattgatttctgctttaagctttgtgtattcctccagtcctaaattcttgatactaattaatttgtttccaacctttatttttctaatatgtacatttaacctatcaatttttctctaaaactgttttatttatttccaacaatctttatatttttattatcattgtacataaaagctttctaatttcacttttaatatctcctctgacccataggctgtttagaagggcattgcttaatttctaaatatttagagatcttctagttatcattctttcattaatttaatcatttgagacatggtttattgcccagaatatggacgattttggtaaaatgttacatatgcacttgaatgtacagttattttgcttcattttctagaaatgtcatttaggaaaatgtggtttagaacagtctttttttccccctccacttgttctctcagttatggagaagcatgtgtaaaatatctgtattagtttcccagggctgctgtaacaaattaccacaaacttagtggcttcaaagaagagaaatttactctcttaacagtttggaggccagaaatccagttaagatgtcaataggattggttccatctgcaagctgttctgtgcctctctccaggcttccttccagtggctgctggcaatcgttgatgttccttggcttgtagatgcatcatttccttctctgtctccatcttctcatcgccttctcctctgtgtgtgtcctttgctcttctgtctcctataaagacactggacatggatttagaggccaccctggcaatccagaatggtcacagctcgagatcattaacgtgattgtatctacaaagactctccaaactgggtcatattcacaggtttcagagatcaggacacagatattttttaaggaggacagtggttattcaacccattacaatccccaactacaactatgaatttgtctgtctttcctctttgttctagcaatttttactttatgtattttaaacatgttattaaatgcatgaaatttttggtttattctttctgctgaattgactattttatcataatgaaatgtctctctttacctctcataatacttcttaccttaaaatctactttgcatattaatacagctatataagctttctttattgtttttatattatatgtgttttaaatcttttactttcagcccttctttgtcttatatttaaagcttgtctcttataaacatcatatagtaaggttttgttgttttattcagtcttagttgttcattggtgtgtttggaacattaaaatttaataataaaaattaaaaataaataaatttaatatagttactgatataaagtctaagtcttggtatttgtttcatgtgtttgttcctttattcctcatttctcacattttttaattcatcaagtatttttattattctatttccccagtagcttttaagttatattccattttttattcttaaatgactactctagagatagacatccttgatttactatagtctgctaaaattgtacttttaccactctccaaacaacgcaagtaccgaaactattaatagttaattccatttatgtcctccccctctttttgtattgttgccatacgttttgcaaaaagaaaagcttcagctgaattaaatttaaaagagtttaattgagcaatgaacgattcgcaaatcaggcagcctcccgagccaaagtaagcgcagagactccagcccagctgcaatgggggaagaggatttaccgacagaaaaaggaaactgacgtacagaaaacagaagtgaggtacagaaacagccgattggttatagctcagcgtttgccttatttgaaaacagttcaaacagttggccacatttgattggccaaaactcggtgattggcgtaagagtagtctgcggtctgtttacatcttcacttgttatagtttgcagtttacagagaaacctttaggctgagcttaaactacgtaaggctttaggctaaacttgatttaacgatttacatatattctatatttcaaagacactgttgtctttataaaaacagtatttatttatatttacaccttagtgaattcttagaatttttatgttgcctcagcatccatttagaatatgtttagctttctcatgccagaagcagggcttagtcacccttaatgccctttctagttctgtacctcctcccaattttgcaacgtggtcgagccagatatctgccttatacaactgcctcctggtgaccacctctctatgggacagctagataaaacctacttgactagcgtccctgacctctgtgccctgcatggacttcgcagatatgctgccgtgaccacctctcagtcgcagcacgactgcctggaacatgtgcctgctttctttaaactcaccaattagaactccccatgggagataccttggcttgtagatgcaagatgctgggtcatactctggtccccaataaaggcattggctgatgggtccccttctctctgtctgtctcctcgcgctgaccaacctctgtgtgatcttcaggcgtgccatacccccagcccgtaataaaatctttactgccatcttgtgtttcttgtaatgactgaagaggttttctctatcataaagatcctaaatgaaaacatacccgcatatgagctctttctggtgtgtttccttcttattgcaattctgtcaattctatatgaaactattttccttcagcctgaaaaagtctctttggcatttttgtattgtagagcttctgacaacaaattctttaaacatttttctaagtgtggttcctctgaaggttattgtccatgtttcctggctgcttttaaaatggattacactttaaaacagattttttacaatattattgtgttgtgtctaggtaagaatttctttgtattgcttgggtttgcacatttttttttttttggttgtttttttttttttttttttttttttgacagaatttcactcttatcacctgggctggagtgcagtggtgggatatctcggctcactgcaacctccgcctccggggttcaagttatcctcccacttcagccttccaagtagctgcaattacaggcctgtgcctccatgcctggctaatttttacccttttagtagagatgggttttcaccatgttgaccaggctggtctcaaactcctgacaagaggtgatctgcccacctcggcctcccaaactgctgggattacaggcatgagccaccgtgccaggcctgtatagccttttgaacctgtaatttaatgatgtcttgcatcagtcttggaaaattctcagttattaattcttcaaatgttgtttatgctcagttctctctctcttctcatcgagggacttcagttaaacatgctaggctttattcttctatgtatttagtctgtattttttaatctttttatatattggtgcttggttttgagtattttcttctgtcctagcttccggttcattgattttctttcagagtctaacctgctattaatctcacacaaattcttaatttcagcaatcatattttacttttacaattctagactttttattttccaaatctgccctcttccttttttttttttttttttttttttttgagacagggtctcactttgttgcccaggttggagcacagtagcataatcatagctcactgcagcctcaaccttcacaggctcaagcaattctcccacctcagccacctgagtagctgggaatgcaggtgtgcaccaccacacctacacatctggataatatatatatatatatatatgtatatatacttttttttttttgtcgagacagggtttcgccatgttgcccaggctggtctcaaactcctgagctcaaacgatccactctcctcagcctcccatagcgttagaattacaggcgtgagccaccacatcccaccctgttctttttaatagtttctagttcttacaagtttcaattatacccttgaacaggtctgtagttctaatgggtcagtttctgtcatcagtaattgtgtgtgttattttatctctccaaatatctggttatctttgattgtgtatcaggaattctatttgaaaactgtgtctgtagaaataatttcaaggccttagataacccatcttcttccagatggaatttttgtcattgtttctgcaggcatctggggacattagcaatctaggaccactctaattcagtctcaggaactgtgattttccagggccacccacagtaccagtacttgaagtactagttccagtctctgagacagcaaatttattttcagttaaccctgattaccagggcctagttcttgtggcctcagaacacatcagaaggtattaccaggccttccatttggggcaggccctggacttccattgttgtcccttaacttcatgagaaaatcaaaagtctgttcagcctctcagttgccccgtcctgattcagctgcccattcccaaacaataagcagcccagttgccaagcccaaatacccagctctcaactggattctcatcttctcctagatcatggcccaggaatgcttcactagtttgttagctttctgatgctttaacagataaatatttttaattctccagtatttctagcctttcttgagggtggatggttggagcaatattttatttgaactgttgagattactattagtagaagcagagcctgaaaaatttttatttttaattttaattcattcatttctaaatttatccaattaaattcactcagttttaatttcaagtgttttgggatttgggttgaagaaattttgttctagtttatagcaacacagtatactatgtactactgctatactttaaaatgtatttaggggtttttgtggactaatatatgatcacttttacacagatatcatcttatgatatcaaacttagatttgatgaaatgagttggtaagcttcatatcttttatatgttgtgaaaccttgaaattacatttggaagtatatttttgaatgaattttggtaatttgtatttccatttatatcatttagattttcaaaatatttaaccccctgtagtctacagttttataaatattctcatatacataaaaatatgtttaaattctttttcctactgtgtatatttgtgttttctctcatcccttatactttatcttttagcaaatgtttttgtattttatttttctaaaaaagctaaccttggttaataacaaaaatggaaattaagaaagcaaacggaaaagagtaggagaaaactgtataaatactataacactatgatcaaagagctatttaaaatgaaaagaatgtggattgagttaatacatgcatgcaaatactataggaaatcatatcagtaagaaaggcaggacacatcatattatgcccattgaagctacaactttataaaaatgtacctatgtgttagcaaagattaaaagcaaataatgaatgtaaaaatagctatagtttagtgactcatgagatttctgtcattcattatttaaactgactgttatttatcctgctcttcctttttccaggaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccaggggtgagtctgactgaggcctagaagggccctgccagtgacatgcgttgctgttggatcaggagattagtatttgttcagggggagggatgtgtgctgagcagggtcgaggagcaaattttctaggtagtgaacatgaaattcagaaggtgtgtgtacatgcacatgtgctgaaattgcgaagcaaagctcaacctgggcaagggatatgatgtttctttggggttcttataaacagatctatcaattacctttgagtataataatggttgatacaaaatgagtgattcctctggccgggcactataatacaggctacatgtgaattttaatccttaaaacaaagttattaggtagttaccagttgttctatgtttgtctgtattgttttgcttgagatactgtcttgatctgtcactcacgttgaactgctgtggtgccatcatgacttacttcaacctccgcctctctggctcaagcaagtctcctgcctgagcctcccaagtagctgggaatataggtgcatgccaccatgcctggataagttttttatatattttttgtagggatagagtctcaccatgttgcccaggctggtctcgaactcctcagctcaagcaattcacccaccttggcctcccaaagtgctgggattataggcatgagccaccgtgcccggcctctatgttttatagagaatatgtgccttagacacatcagataacattctgagacagtaacttgcagacaaaactggattgcaagtccacctcactccagagccttggctttgctcatcagcattcagtcatgaaatcaaaacttactctagatactttcaaggagggagggatttcatgcaggttgtattagtctgttctcacattcctataaaaaactacttgagcctgggtaatttataaagaaaagatgcttacttgactcagagttctgtaggctgtacaggaggcatggctagggacccctcaggaaagttacaatcatggtggaaggtaaagaggaagcacgcatatcttcatatgcttggcaggagagagagagagagcaaggcagaggtgctacacactttggaacaagcagatctcgagagaactctatcacaagacagcactagggtgatggtgctcaaccataagaaaccacctccatgatccagtcacttcccaccaggctccttctccaacactgggaattaccatttgacatgagatttgggaggggacatagagccaaatcatatcgcagctaataggtcacaaaaatgttagaagggcaggaaaagcaataggacaaaggcaaagttacgagagatcagggagctgctgtggctcccagtctacagcacaggagcctggagtgatggtgaaatggccagcccctcccactgagcaggcagctccctgtaagctgctagtgctgcaggagccaccactgctgccagaatgcagctgatattgctggagccaaagtcattggcatcgttacaattgaagctgtagctactcactgaagccatctatactgccactgcctgagccacttctagaagtagaacagattctgccatcatcctgctttttaatttggtatatatgcctccaattggcagaacctaaccagagcccagctatcaaggaagatgaacaattgtagttttaaggcttcctttgctagctgtcaaaagacagtgcagaagtgtgaggctgggggccaacagaaatttaaccagcacagcacctcaatattacatcaccaggcattgattagtccagggaaacactgggtgatgagccctgaaaatggacattacagcatcagagtatttacaaactccctaaagaagtcatttttctattccaatcccccatttgatgcttgagaaagctgaagtccagaaaagggaactgatctgctcaaagacaaaccgaaattattttttccattttataacagttttatgtaatttagttgagatccaaatgtgttctgatttcctgagttccaatcaactatattaagagagagccagcgctgcccttacaatatgttgcgtaaatatacactctcatcatggtgacagtaggtctttcagattttgttcgacagtttcccaccttctcactgaagtgaaatgaatgactaggcagcaccttgctacatagcatgaggagaggagacccatagttctttaccatcctatgtcaggtggccgctgagagaagacttgaaaggagatgagcatagatgtatggacgctctttgttgcaccagtgtgataggtgatggagggacctattagatgagacatgggcaggggcactcctttattgcttaaaatgcaagactaaattggtgatgcctttctagaaaggaagtatgaagatacgaaaatccatcattcctcccaattttgtactgggtgaacagtaattggaagcattctagaaggaactgtccattgtgaaatcttagttgcatactttagatgaaaaacaatgaattggagatacctctgttttagtcacagttgtgccacgtgtcagttctatgactgatggcaagacatcttccttgccctgtgtatttagtttatcaatgtaataaggctgttattctaactttattattatatatagatttgtaattattattcccttggccagtttaacagtgagaaaaaagttgttttcacacaattagctgtactttgtttctctctccccagtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaaggtgactagactcttatctggcttgatatttttagcttgcgtctttattctccacatgccagtgatttctgttcgtttttctttatctccagtgaaatcctgtgatgacttcatgggccaacttcttaatggccgtgtgctatttccagtaaatctccagcttggagcaaaagtggattttgtttgtgatgaagggtgagtatgagcttgcctgacctgctggacattgaaattggggttgggaatcagtctaaaaaggggagatttggtgtggcacacacacacacaccttcagagagatgaactttcgaaagtatacctaggaagaaaggaaagaaacatatagaactaataacatgagatatgaagaggaaactggaacatatattaactggcaagttcaaaggcaagtataactactggttatgaatatataagtaacacattaagcaaaaaatatcagccagaaacggtggctcacccctgtaatcctagcacctttgggaggttgaggcgggcagatcacctgaggtcaggagttggagaccagcctggacaacatgatgaaaccctgtctctactaaaaatacaaaagttagctgggtgtggtggcatgtgcctgtaatcccagctattccggaggctgaggcaccagaatcacttgaacctgggaggtggagtttgcagtgagccgagatggcaccattgcactccagcgtggacaataagagtgaaactccatctcaggaaaaaaaatcatattttacaagcaaaaaggaatatgagtaatttagagagtcccaggaaaaaactggaagtaacaaaagcttattataaaaagctaggatcatttgtgaatcatttcagtaaattctttaaatcgtcaacagtgaaatttgtaataggactgaaaatgtaaaaatcagcattttttaaaaaaatccagccatatatcatctggttaatcatgggctctgggctctgagctggggtcctgatggctgctgttaatatttccagcaagctcattaccttgtttatgtccacctagtgctcttcgcagggtgcacatctctacacgggagctgaccggcatgggcaacaaagcacctgatcccaaaatgtaacacagaatcttggcagcctccaaatgccagcacccagtaagagttaggagggcatcggggtccagcagacattgagaattttcgacaattgcatgcaaaaaataagtcctctcttctttcctttttcccctagaatattcatgcttactcttcagcagcccaaattgcccttttgagccttcttcacgccatcacagatgtggagatgaaaggacagtctgttctctcgccagctatttcccacttttccactccaaactgggagctgttttacttgctgttccagggtcagagttaggaaggcattacattagaagactgggtttctaataacaacaatgagtgatttatcaggttatcatggagtaatcagtgaaactccaagcctgggtcctgggtcaaggggatggcgcctatgtcatgaccacctttttcagttcaagcaggactatcatgtgaccaagctactgcattttgccattctatattgttcccttctggaggctgtgatttttccagaataaggtagcctgtgcaactctgccacctgctggcctaaggtcctaataatcctgaaattggggctgggccttagattgtgaactaagggttctcttggctgaaacagctcacactattcactcctattttcttctttagatttcaattaaaaggcagctctgctagttactgtgtcttggctggaatggaaagcctttggaatagcagtgttccagtgtgtgaacgtgagtagcaggagtaacatttcaggccagtctctcccttcatctgttcagtatttgacccatgacctcccctaatgtggttcttcaattttctagtttgaattattgatttgaaaattgcttattttaataatgtttggttgtgaatcaaatgtatacatcacctgtctttggaaccatctgatctgtctctgtccttctgtattctgtgttctagtgcgataaatcctatggtagcatgattctaggtcaggagagattagataatgtgaagccttaacaatttgctttctttctctctttcttttgtttcttttttctcttccttcctttcttcagttctttcttcccttctctttctctcccctttcttccttccttcctccttctttcttttccattttgttcttccatcaggtgcagtctacaatttttgtatatatttgataatacacaaatattaaacatgcctttatttaatcaatatttattgatcacatactttgtgcctgatgttcatctagccacaggagttatatcagtgaacaagatgaatgaattccctgtccccatgttgtttccactcagttggggaaagggacaagaaaaaaaataaatacgatgctatgaagatagtagagcaaagcatttaggcatgagggaaaagtgaggagcaacattagacaaggcgagcagtttgagactccttaaattctcaaaacatgtacctaaataatttatgctgagagattcataaataatgtcatttttaaaaatttattatacttttaagttctagggtacatgtgcacaacgtgcaggtttgttacatatgtatacatgtgccatgttggtgtgctgcacccattaactcgtcatttacattaggtatatctcctaatgctatccctccccgcttcccccaccccacaacaggccccggtgtgtgatgttcccctttttgtgtccaagtgttctcactgttcaattcccacctatgagtgagaacatgtggtgtttggttttttgtccttgtgatagtttgctgagaatgatggtttccagcttcatccatgtccctaaaaaggacatgaactcatcaatttttatggctgcatagtattccatggtgtatatgtgccacattttcttaatccagtctatcattgatggacatttgggttggttccaagtctttgctattgtgaataatgcagcaataaacatatgtgtgcatgtgtctttatagcagcatgatttataatcctttgggtatatacccagtaatgggatcgctgggtcaaatggtatttctagttctagatctttgaggaatcaccacactgtcttccacaatggttgaactaggttacagtcccaccaacagtgtaaaaatgttcctatttctccacatcttctccagcacctgttgtttcctgactttttaatgatagccattctaactggtgtgagatggtatctcattgtggttttgatttgcatttctctgatggccagtgatgatgagcattttttcatgtgtctgttagctgcataaatgtcttcttttgagaagtgtctgttcatatccttcacccactttttgatggggttgtttttttcttttaaatttgtttgagttcattgtagattctggatattagccctttgtcagatgagtagattgcaaaaatgttctcccattctgtaggttgtctgttcactctgatggtagtttcttttgctgtgcagaagctctttagtttaattatatcccctttgtcaattttggcttttgttgccattgcttttggtgttttagacatgaagtccttgcccatgcctgtgtcctgaatggtattgcctatgttttcttctaggatttttatggttttaggtctaacatttatgtctttaatccatcttgaattaatttttgtatacagtgtaaggaagggatccagtttcagctttctacatatggctagccagttttcccagtaccatttattaaatagggaatcctttccccatttcttgtttttgtcaggtttgtcaaagatcagatggttgtagatgtgtagtattatttctgagggctctgttctgttgcattggtctatatctctgttttggtaccagtaccatgctgttttggttactgtagccttgtagtatagtttgaagtcaggtagtttgatgcctccagtttgttcttttggcttaggatagacttggcaatgcaggctttttaaataatgtcatttttaaaaaatgagccccatatgttcaataatgagtagactactgatttctcctagtctccccatttataatttccccaatagaagatagaactttgcttcatttcttgattctaatgattgggaaatgtgtttctttagaaaaccatgaaattttactaaaatgtttatgttgttagaaatggacatcttacagtgctttttagagtaaaattttggaagaacataacttatatagagattcttgctgtctaagaaattcagtgctccttgaagcagcatgacaaatttctgttctaccatcatgaatgaaagctcattgattggactactcaagctttctcttatttttcataactgttgctagttaaagtagcttcttccaaattccagttctaatgaaaaatgccaattagaaatgaggaagaaactgttctaaacaaatcagcagatgctagaaaggagaaacaacttgaaacctgacccagaaagttaaaagagaaaataaatcatcaacagacctagacattttcaaaagcaaagccatctgaatccatttggagttgttttttatcatggccttactatgttttaattcactgtgacagggctattgttatcactgagattgatgatcaatatcaagaagtaatcagcgaaaggtttcacctatttaagatgattagcacacatatgtacatttgagaaatatttcctaagaatgcaggctccttcctcagcactctgtccccaggatcctgatgagtggctgacacaggacaagtgcttaattaatatatattgactaaatgaatgagcaacccttcaaaatggctatttttctttttcaaatgttttgctacttcattaaagttgtaaagtttccattgtccaggaaccgttactatccggaagattcaggatagacaagtctcttttgtactttgcaatacactttcattgatatctcatttaatccaactcttcaaagtcctaatgtctactgtcatctccttagcatattttcagcaacaccaatcatagcaccctgtaattgcagaatacctctggtgaaactcctgaatgaaacttagagctttcatgttttttctagaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggttagtgctcatttccccacatcccaaatgggttcagaatatctaacccaggccctccatatttccgtaattacaatgtggtatttatttgtgcatttgccacaatggaatgccaaaccaatgatagatggttctaaggtaggtcaacacataagatcctgatgacctttgcagatggagggactgatgaaaaaagagggaggcggtgagtggtgggaaagtccttcattagaatcatatgaattaaaaacagatgcctgtgaatctccttattgaaatgtttggtttagaaatctgacctagaaaatcggtggctccttctgccaggaaacgtcttgagttcccgcccatgcttgacagcctctcattggagttttgatgacttgaagtacaaggaaaccagacaggaaaggtggaacctgggcagaaaaactctttctggcttcctaaaaatgtgaaaaattaaatgggagctatctttacattaaattatatgagcattagctgagcgtggtggcaattgcctgtggtcccagctactcgagaggctgagatgggagtatcccttaagcctgggaggcagaggttgcagtgagccaagattgtgccactgcactccagcctgggtgacagagcgagaccctatctcaaaaacaataaaaataggcattaggaggccaaggctggtggatcactagaggtcaggagttccagaccagcccgcaaacacagtgaaactccaactctactaaaaatagaaaaaaaatttaaaaacaaaaataaattatatgagtagaaagaccagatagcaggctagtcttccaaataatatacttccttataagcctatgctaatggaactttcctttctattttacagggaagttttttttttttcataactaaaattttcttttcttctggcatcaaatctaccaaggaagagaaaagaggaaacacactgggtatctttttattaactcaaatattcttgatttcttggtctctaggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtgcgtaaacttgcgttggatctttcccatgtctgcaaaagcttcttatggaattatttcaaatgtgggatatgagaaaccttttctgaaaagtgttcggatagatggatgtaagagtttttcttgtaggcatccttgattgttgcttgaaatgttaacttcatgagaatgtttcaagaaatagttgtagagaaaatcttcattccctatgggaaagaaaataataaatgactagatcaggaaaaaaatggtgtaggaagacaaattctgtttgaataactaggtgggaagaaatcctttgcaaactttgaaatatattgatagtaaataatgccataaatgacctttacattttgataagggatgcaaggtctctacacagatctaaatctagatctagatagatctggagggaaggtctttttgaaagtggggcttagtaggtggctgatcctcagcgctctgatgagttttctcaaggtgccaaaatctgtggaaccatcagagccgcgtgttttcttcaggaagctacatgcaggttgagaccttacgtactgaagagagttcagattactctacctggctccaaaacattttctttcccacaggtaaatcatgtaaaactcctccagatccagtgaatggcatggtgcatgtgatcacagacatccaggttggatccagaatcaactattcttgtactacagggtgagttggcagcaacatctcttggtttaagagttccagcacagcgatagtactttctagccacatctcagcaaggaaactaggctattgccacctgctcttaagaggcttgaacacaggtgttaactcctgattgaaatgaacaaagataggagaagattagggggaaaatctgtatccttgctggaaaccagggcagtgcacatataaagagtatgctgttcactggatgggaaggaaaaaaacttagaagtgtagtagtcaaagcacacaaacaaccctaacccagagtagacattgctggaagaaagggaagaccatgtagcagctgtgtgagagaatgaatcttaatgataacagcatgatcccttgctagggctgccatcaaaaagtacaggccttcctcgttttattgtacttcgcagatgttatgctttttacaaattgaacgcttgtgggaacgctgtgtaagcatgttcgtcggcatcatttatccaacagcgtgtgttgacttcgtgtctctgtgtagcattttgattattctcacagtatcccagatgttttcattattatcatgtctgtgatagtgatctgtcatcagtgatctttgatgttactattgtcattgtttggggtccctacgaactgcacccatataagacagaaaacttaatcaataaatgtgcgtgctttgactgctccatggactagacattccccttctgtctccctctcttcaggactccctaatccctgagacacaataatactaaaatgactccaattaataaccctacaatagcctttaagtgttgacatgaagggaagagtcatgcatctcttactttaaatcaaaagctagagatgattaagcttactgaggaagatacgttgaaaaccaagataggccaaaagccattcctcatgtgccaaacagctagaaagttgtaaaggcaaagtaaaaatacttgaaggaaatttaaaatgctcttccagtgaacacatgtatgataagaaggtaaaacagccttattgctgatatggaagaagttttagtggtctagacataagatcaaactagaaacatttcctgaagccaaagcgtaatcctgagcaaggccgtaactctcttcaattctgtgaaggctgacagaagctggaagctagcagaatttggttcctgaggtttaaggaaagaagccctctccataacataaaggtccaaggtgaagcagccagtgctcatatagaagttgcagcaagttatctagaaaatctagctaagatcactgacgaaggtgttacactaaataacagattttccatgtagacaaaacagccatctattggactttcatagctagagaggagaagccaatacctgggttcaaagcttcaaagaacaggctgactttttaggagctaatgccgctggtgactttgagttgaagccaatgttcaccgaccattctaaaaatcctagggcccttaagcattaagttaaatataccttgcctgtgtctataaatggaagaacaaagcctgatgacagaggtatgtttgcggcatagtttactgaatattttaagcccactgttgagatctagtgctcagaaaaacagattcctttcaaaatattactgctcattgacattgcacctaagcagccaagagctctaatggagaaggacatggagatgaatggagttttcctgcctgctaacaacagcagccattctgcagcccatggctgaaggagtaattttgactttcaagtttcactatttaagaaatacattttgtaaggtgagtccccacagacagtaattcctctgatggatctgaacaaaataagttgaaaactgctggaaagaattcatcattctacataccattaagaacattcgtgattcatgggaagagcttaaaatatcaacattaataggagtttggtagaagttaattccaaccctcatggctgactttgagaggttcaagacttcagcggaggaaataactgaagatgtggtgaaaatcgcaagagaactacaattagaagtggagcctgaagacgtgactgaattgcgacaaattcatgatcaaacttgaacagatgaggagttgcttctcatgaatcagcagagaaagtggtttttttgaggtggagtgtcttcctggtgatgatgacatgagcattgtgaaaatgaccacaaaggatacagaatattacaaaaacttaggtgataaagcagcagcagtatcgggaggattaactccaattttgaaagcagttcagagggtaaaatgttatcaaacagcattgcatgctagaaaaatcttttgtgaaaggaagagtccatcaatacagcaattttattgctgtctcagcttaagaaattgccacagccaccccagccttcagcaaccaccaccctgatcagtcagcagccatcaaccttgaggcaagaccctccaccaacaaaaagattacaaattattgaaggtcagataatctttagtattttcttatcaataaacctttttttaaagtatgactttgtttagacataatgctatttcacacttaatagactaccgtatagtataaacacaacttttagactcactgagaaatcaaaaaattcatctgactcatttgttgtgatatgtgttttattgtggtggtctggaactgaacctgcaatatatttgaggaatgtctgtaacacgaagtgggcggcttaatacaacagaagtttttggagttccattctagagactggaaatccaaaatcaaggttttgggagggccacgctccctctgaatcctgtagggaaggatccttcattgcatcttccagcttctggagccacaggccttccttggcatgtggcagcagaactccaatttctgtctctgtcctcatatggccatcttccctctgggtctgtgtcctcatatgctgttctctctgtgcatgtctgtttccaaagttttcccttttaataaggacaccagtcacactggattagggcctaccttcatgacctcaccttaacttgattgcgtctgcaaagatcgtatttccaaataaggtcacatccacagggactggaggttaagacttcagcatactcaggggagacacaattcaacctataacagagcccctttgaaaatgtcaggcatcaggtgctcacagcacacggtccagctgttggtgctcacccttgctcagcacacggtggaggctctgcctcaatctcattcttcatgggaacagctaagccaggtagcgaatacgagttacgtttgtgtcaccacagcagacactgaaaggaagtttgtggtgtccagcacatttgccagcataggcctcacagaccacaacacctagaatctgacaaaaattagaataaatccgatgtctccttttctctctttttttaagcatttttaaatacaattggtaaatttcctgactgtaccctactcatcttgcattgctgaataagtgaggaacctctctatggcatgaagcagaaaaccattgagcttatgagaagaaacaggaaatacatgtaaaagagaccagtctgaaaaatcaggagaaattttacaaaagagatttactgccaagaaaccagggaaactttcagaacactctccttttcatatttgtaacaagattcaattgtacaaatacttctgtgaaactagccatgaagtgtgtacatgaatgaatatatgtattcagtgtgtttatatatttcatttcatacatgtgatctatatcatatatatatatatatatatatatatatatcacaatgaatattgcagaaaattaaagcaaagagtaagaagagttaaccaaatgttccctgaatgcagtgggaaaagatgaaaaggagaagacaggcaagcacagtggctcacacatgtaatcccaacatattgagaggccggggcaagaggatcacttgagcccaggagctcaagaccagcctggacaacatggcaaaaacccatctctacaaaaaagtataaaaattagctgggcatggcagcatgtgactgtagtcacagctaggcaggagaatgaagtgggaggatcacctgagcccaggaggctgaggcttcagtgagccttgatggcaaccctgcactccagcctggatgacagaatgagaccctgtctcaaaaaaggaaaaagagaagacatatgtaacacagtgtcaggattcaaaatacatgtagcaaaaattccagaagggtaagcaaataagcccatacctagccatcactagggaaacttctgtgtttcagggatagagaaaaaaactctgattccagaaataaaatgtgaaaatataatacccgcaaaagaaataaatttattgacaccacattgattctatattgtataagatatattgtataacactaaattgtagaagatagcacttctcttgagccaagctaatatgcacacctagaggctccaggtacacattaaaggataagcaaagacacaaaaattgtaccatttaagtatgtttcccaggcaattcataagcaaatttttaaaaaggagaatgatgaattccaaaggaaatctcaatgagataggatgtaggtaaaaagaaaaaacaacaataaaaaaaacatacacacaaaatcttggcaatgtaataataatttattaataatctctctaaactcatagaatatatcaataaaactagaaaatgtgagacagcaagaaaagataggctagacttacattacagaaaagatgagtagactgactatatagagtttgactctaaaattgagaaaagaggtttaaatatgtgtcacgtgtatatgtataatatacatgcacacatataaaatgaaattcctcactggaaaaaatattaagtttaatttccaaattattagaatgactaaaacagttgaatctatctgttccatatagtaattgagggggaaggaaaaggaatagcaaggaatccatttttctcttccaccagaaataagctccctcatgtttgggtcaggtcactttattcattgctttctccacatcctcatcattaggcatcatgaaatcaatgaaaaggcagtgaaagaatgatgatgaaagctaatcaaatgtatcatttacctcaatacgtttggtttaatcttcttgttgaaagacaaattctcctagacaggatcaaaagcaacatatcttgtatttataaaaaacatgtctcaagtaaaatgacatagtattatacacacacacacacatacacacacacacacacattaagggaaaatgcagacaaaaaatggcagaaataatatttagagaaagatagaatttaagaaaaaaaattgtcaaacaggtctgcaaaataattgttttattttggtgccagttacagtccgcaatgaagcgaagatattaagaagcaaagtgggccaggagaaattagagcagaaatatctctttcaatagtgagagaataggaaaaagaagtagaaaagctgggaacaataggtaaagtttaggctaggccttagacttctcctgcattgtaatccctctggtttgccacatatgcatgctgtcaggaagttgatgaggtatgtacagcacaatttattttccattttttgcctttaggcaccgactcattggtcactcatctgctgaatgtatcctctcgggcaatgctgcccattggagcacgaagccgccaatttgtcaacgtgagttgaaatctctttccccattcaccccaccgtttaatcctagagttgtcctcctagaattacaaagaatggatctcatccctcttggaaatggtatccttctcatatttgaagaatccagtcatatccttaaaatggctcacagcattccaaacttccaccttcagctagaaatgcttttttattttttcttatctcaaggtctaattttttttaaactagtctttagctcacttaaacagtcccccaatttcatcctctgttgggtgaacacctcccagtttaaagagcattttatttagtgaagtcaacaaatacaaagtcagtgaaagaaaccccatatcctctctgcaagctcttagtatcacatcagatattcaagccatgcagctctttcttccttcttattctttgtctaaacaggatcatgccatcttccctgtgagttgtttggaagatgagctttctacattttggggagcaaagacgaatgagcaattgcaagctaacaaggaatataaaatgtgtataatcctgggtttagtgatggtgtgaggaaatcagcaatttcaaacccagttggtgggaggataagtgggaacaaactttgtagaaggccaataaactggctgggcactgccctacggtagagtaggacacagtattcagttcttccaagatcagacgagattgggcgcatttagggtggtatggttgtagatcagtatccagttctttttattatttctgaatctgtaagtatcatgtttattatatgtaatattgtatatttgtactttgtctttgttagttcttccagagcttttgttcttattatttaataaagatgttatactgagccacatgtggtgactcaaacgtgtaatcccagcactttgggaggcctaggtgagcagatggcttgagtccaggagtttgagaccagcctgtacaacatactgaaacgctgtctctacaaaaatacaaaaactatacgggcatggtggcacatgcctgtagtcccaactactcaggagactgagaggtgggaggattgcttgagccagagaggtcgaggctgcaatgagccatgatcgtgccactgcactccagtctgggcagcagagcaagaccttgtctcaaaaaaaatgctatgctgtatgctttattatattaatatccaatagaataaagacacatgccttctatatagagagaactaaattaataatggtgagataacagttaaattctcatttagcaggagaaataaaaacatagactataggctaggcacagtggctcatacctgtaatcccagcacattaggaggctgaggtgggcagatcacttgaggtcagtagtttgagaccaccctggccaacataatgaaaccccgcctctactaaaaatacaaaagttagccgagtttggtggcgcatgcctgaaatcccagctactcaggaggctgaggcaggaaaatcgcttgaacctgggaggcaagggctgcagtgagccaagatcacgccactgcactccagcctggggaacagagtgaggatctgttaaaaaaaaaaaaaaaaagtggactctaataatacatggacacatttagtgaaataaacttaactgagtagagcagaacttataatattttaaaactgtaagaacatgtctgtacattagcaaatagtagatgagaatagtattttcaatatttacttctggtaatttggaattaaaaaaaaaacttttgggaaaatttacaataaagtatgattttaacaaaccaggctaggcgtggtggctcacgcttataatcccagcactttgaaaagcagaggcatgcagattgcttgaggccaggagttcaagactagcctgcccaacatggccaaaccccatctctactaaaaatacaaaaataaaccagacatggtagtgcatgcctgtgatcccagctactcgggaagttgaggtaggaggattgcttgacctgggaagtggaggttgcagtgagccatgatcgtgccactacactccagcctgggtgacagagcaagactctgtcccaaggttttgttttggttaacttgctgtccctttttccaggaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccaggggtgagtctgactgaggcctagtagggccctgcaagtgacatgcgttgctgttggatcaggagattagtatttgttcacggggagggatgtgtgctgagcagggtcgaggagcaaattttctaagtagtgaacatgaaattcaggtgtgtagacatgcacatgtgctgaaattgagaagcaaagctcaacctgggcaagggatatgatgtttctttggggttcttataaacagatctatcaattacctttgagtataataatgtttgatacaaaatgagtgattcctctgcccaggcactataatacaggctacatgtgaattttaatcctgaaaacaaagttattaggtagttcccagttgttctatgtttgtctgttttgttttgcttgagatactgtcttgatctgtcactcaggttggactgcagtggtgccatcatggcatacttcaccctccacctccctgactcaagcaagtctcctgcctgagcctcccaagtagctgggaatgtaggtgcatgccaccatgcctggctaagttttttatattttttttgtagggacagagtctcaccatgctgcccaggctggtctcaaactcctcagctcaagcacccacccaccttgggctcccaaagtgctgggattataggcatgagccactgtgcccggcctctatgttttacagagaatatgtgccttagacacatcagataacattctgagacagtaacttgcagacaaaactggattgcaagtccacctcactccagagccttggctttgctcatcagcattcagtcatgaaatcaaaacttactctagatactttcaaggagggagggatttcatgcaggttgtattagtctgttctcacattcctataaaaaactacttgagcctgggtaatttataaagaaaagatgtttaattgactcagagttctgtaggctgtacaggaggcatggctgggaaagttacaatcatggtggaaggcaaagaggaagcacgcatatcttcatatgcttggcaggagagagagagagagcaaggcagaggtgttacagactttgaaacaagcagatcttgacagaactctatcacaagacagcactagggtgatggtgctcaaccattagaaaccacctccatgatccagtcacctcccaccaggctccttctccaacactgggaattaccatttgacatgagatttgggaggggacatagagccaaaccatatcgcagctaataggtcacaaaaatgttagaagggcaggaaaagcaataggacaaaggcaaagttacgagagatcagggagctgctgtggctcccagtctacagcacaggagcctggagtgatggtgaaatggccagcccctcccactgagcaggcagctccctgtaagctgctaatactgcaggagccaccattgctgccagaatgcagctgatattgctggagccaaagtcattggcatcgttacaattgaagctgtagctactcactgaagccatctatactgccactgcctgagccacttctagaagtagaacagattctgccatcatcctgctttttaatttggtatatatgcctccaattggcagaacctaaccagagcctagctatcaaggaagatgaacgatttatttttaaggcctccattgttagctgtcaaaagacagtgcagaaatgtgaggctgggggccaacagaaatttaaccagcacagcacctcaatattacatcaccaggcattgattagtccagggaaacactgggtgatgagccctgaaaatggacattacagcatcagagtatttacaaactccttaaagaagtcatttttctattccaatcccccatttgatgcttgagaaagctgaagtccagaaaagggaactgatctgctcaaagacaaactgaaattactttttccattttataacagttttatgtaatttatttgagatccaaatgtgttttgatttcccaagatcagatcaactacattaagagagagcctgagatgccgttacaatatgttgtgtgaaattacactctcattatggtgacagtaggtctttcagattttgttcgacagtttcccaccttctcactgaagtgaaatgaatgactaggcagcaccttgctacatagcatgaagagaggagacccatagttctttaccaccctatgtcaggtggccgctgagagaagacttgaaaggagatgagcatagatgtatggacgctctttgttgcaccagtgtgataggtgatggagggacctattagatgggacatgggcaggggcactcctttattgcttaaaatgcaagactaaattggtgatgcctttctagaaaggaagtatgaagatacaaaaatccatcattcctcccaattttgtactgggtgaacagtaattggaagcattctagaaggaactgtccattgtgaaatcttagttgcatactttagatgaaaaacaatgaattggagatacctctgttttagtcacagttgtgccatgtgtcagttctatgactgatggcaagacatcttccttgccccgtgtatttagtttatcaatgtaataaggctgttattctaactttattattatatatagattcgtaattattattcccttggccagtttaacagtgagaaaaaagttgttttcacacaattagctgtactttgtttctctctccccagtatgtcagccacctccagatgtcctgcatgctgagcgtacccaaagggacaaggacaacttttcacccgggcaggaagtgttctacagctgtgagcccggctacgacctcagaggggctgcgtctatgcgctgcacaccccagggagactggagccctgcagcccccacatgtgaaggtgactagactcttatctggcttgatatttttagcttgcgtctttattctccacatgccagtgatttctgttcgtttttctttatctccagtgaaatcctgtgatgacttcatgggccaacttcttaatggccgtgtgctatttccagtaaatctccagcttggagcaaaagtggattttgtttgtgatgaagggtgagtatgagcttgcctgacctgctggacattgaaattggggttgggaatcagtctaaaaaggggagatttggtgtggcacacacacacacaccttcagagagatgaactttcgaaagtatacctaggaagaaaggaaagaaacatatagaactaataacatgagatatgaagaggaaactggaacatatattaactggcaagttcaaaggcaagtataactactggttatgaatatataagtaacacattaagcaaaaaatatcagccagaaacggtggctcacccctgtaatcctagcacctttgggaggttgaggcgggcagatcacctgaggtcaggagttggagaccagcctggacaacatgatgaaaccctgtctctactaaaaatacaaaagttagctgggtgtggtggcatgtgcctgtaatcccagctattccggaggctgaggcaccagaatcacttgaacctgggaggtggagtttgcagtgagccgagatggcaccattgcactccagcgtggacaataagagtgaaactccatctcaggaaaaaaaatcatattttacaagcaaaaaggaatatgagtaatttagagagtcccaggaaaaaactggaagtaacaaaagcttattataaaaagctaggatcatttgtgaatcatttcagtaaattctttaaatcgtcaacagtgaaatttgtaataggactgaaaatgtaaaaatcagcattttttaaaaaaatccagccatatatcatctggttaatcatgggctctgggctctgagctggggtcctgatggctgctgttaatatttccagcaagctcattaccttgtttatgtccacctagtgctcttcgcagggtgcacatctctacacgggagctgaccggcatgggcaacaaagcacctgatcccaaaatgtaacacagaatcttggcagcctccaaatgccagcacccagtaagagttaggagggcatcggggtccagcagacattgagaattttcgacaattgcatgcaaaaaataagtcctctcttctttcctttttcccctagaatattcatgcttactcttcagcagcccaaattgcccttttgagccttcttcacgccatcacagatgtggagatgaaaggacagtctgttctctcgccagctatttcccacttttccactccaaactgggagctgttttacttgctgttccagggtcagagttaggaaggcattacattagaagactgggtttctaataacaacaatgagtgatttatcaggttatcatggagtaatcagtgaaactccaagcctgggtcctgggtcaaggggatggcgcctatgtcatgaccacctttttcagttcaagcaggactatcatgtgaccaagctactgcattttgccattctatattgttcccttctggaggctgtgatttttccagaataaggtagcctgtgcaactctgccacctgctggcctaaggtcctaataatcctgaaattggggctgggccttagattgtgaactaagggttctcttggctgaaacagctcacactattcactcctattttcttctttagatttcaattaaaaggcagctctgctagttactgtgtcttggctggaatggaaagcctttggaatagcagtgttccagtgtgtgaacgtgagtagcaggagtaacatttcaggccagtctctcccttcatctgttcagtatttgacccatgacctcccctaatgtggttcttcaattttctagtttgaattattgatttgaaaattgcttattttaataatgtttggttgtgaatcaaatgtatacatcacctgtctttggaaccatctgatctgtctctgtccttctgtattctgtgttctagtgcgataaatcctatggtagcatgattctaggtcaggagagattagataatgtgaagccttaacaatttgctttctttctctctttcttttgtttcttttttctcttccttcctttcttcagttctttcttcccttctctttctctcccctttcttccttccttcctccttctttcttttccattttgttcttccatcaggtgcagtctacaatttttgtatatatttgataatacacaaatattaaacatgcctttatttaatcaatatttattgatcacatactttgtgcctgatgttcatctagccacaggagttatatcagtgaacaagatgaatgaattccctgtccccatgttgtttccactcagttggggaaagggacaagaaaaaaaataaatacgatgctatgaagatagtagagcaaagcatttaggcatgagggaaaagtgaggagcaacattagacaaggcgagcagtttgagactccttaaattctcaaaacatgtacctaaataatttatgctgagagattcataaataatgtcatttttaaaaatttattatacttttaagttctagggtacatgtgcacaacgtgcaggtttgttacatatgtatacatgtgccatgttggtgtgctgcacccattaactcgtcatttacattaggtatatctcctaatgctatccctccccgcttcccccaccccacaacaggccccggtgtgtgatgttcccctttttgtgtccaagtgttctcactgttcaattcccacctatgagtgagaacatgtggtgtttggttttttgtccttgtgatagtttgctgagaatgatggtttccagcttcatccatgtccctaaaaaggacatgaactcatcaatttttatggctgcatagtattccatggtgtatatgtgccacattttcttaatccagtctatcattgatggacatttgggttggttccaagtctttgctattgtgaataatgcagcaataaacatatgtgtgcatgtgtctttatagcagcatgatttataatcctttgggtatatacccagtaatgggatcgctgggtcaaatggtatttctagttctagatctttgaggaatcaccacactgtcttccacaatggttgaactaggttacagtcccaccaacagtgtaaaaatgttcctatttctccacatcttctccagcacctgttgtttcctgactttttaatgatagccattctaactggtgtgagatggtatctcattgtggttttgatttgcatttctctgatggccagtgatgatgagcattttttcatgtgtctgttagctgcataaatgtcttcttttgagaagtgtctgttcatatccttcacccactttttgatggggttgtttttttcttttaaatttgtttgagttcattgtagattctggatattagccctttgtcagatgagtagattgcaaaaatgttctcccattctgtaggttgtctgttcactctgatggtagtttcttttgctgtgcagaagctctttagtttaattatatcccctttgtcaattttggcttttgttgccattgcttttggtgttttagacatgaagtccttgcccatgcctgtgtcctgaatggtattgcctatgttttcttctaggatttttatggttttaggtctaacatttatgtctttaatccatcttgaattaatttttgtatacagtgtaaggaagggatccagtttcagctttctacatatggctagccagttttcccagtaccatttattaaatagggaatcctttccccatttcttgtttttgtcaggtttgtcaaagatcagatggttgtagatgtgtagtattatttctgagggctctgttctgttgcattggtctatatctctgttttggtaccagtaccatgctgttttggttactgtagccttgtagtatagtttgaagtcaggtagtttgatgcctccagtttgttcttttggcttaggatagacttggcaatgcaggctttttaaataatgtcatttttaaaaaatgagccccatatgttcaataatgagtagactactgatttctcctagtctccccatttataatttccccaatagaagatagaactttgcttcatttcttgattctaatgattgggaaatgtgtttctttagaaaaccatgaaattttactaaaatgtttatgttgttagaaatggacatcttacagtgctttttagagtaaaattttggaagaacataacttatatagagattcttgctgtctaagaaattcagtgctccttgaagcagcatgacaaatttctgttctaccatcatgaatgaaagctcattgattggactactcaagctttctcttatttttcataactgttgctagttaaagtagcttcttccaaattccagttctaatgaaaaatgccaattagaaatgaggaagaaactgttctaaacaaatcagcagatgctagaaaggagaaacaacttgaaacctgacccagaaagttaaaagagaaaataaatcatcaacagacctagacattttcaaaagcaaagccatctgaatccatttggagttgttttttatcatggccttactatgttttaattcactgtgacagggctattgttatcactgagattgatgatcaatatcaagaagtaatcagcgaaaggtttcacctatttaagatgattagcacacatatgtacatttgagaaatatttcctaagaatgcaggctccttcctcagcactctgtccccaggatcctgatgagtggctgacacaggacaagtgcttaattaatatatattgactaaatgaatgagcaacccttcaaaatggctatttttctttttcaaatgttttgctacttcattaaagttgtaaagtttccattgtccaggaaccgttactatccggaagattcaggatagacaagtctcttttgtactttgcaatacactttcattgatatctcatttaatccaactcttcaaagtcctaatgtctactgtcatctccttagcatattttcagcaacaccaatcatagcaccctgtaattgcagaatacctctggtgaaactcctgaatgaaacttagagctttcatgttttttctagaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggttagtgctcatttccccacatcccaaatgggttcagaatatctaacccaggccctccatatttccgtaattacaatgtggtatttatttgtgcatttgccacaatggaatgccaaaccaatgatagatggttctaaggtaggtcaacacataagatcctgatgacctttgcagatggagggactgatgaaaaaagagggaggcggtgagtggtgggaaagtccttcattagaatcatatgaattaaaaacagatgcctgtgaatctccttattgaaatgtttggtttagaaatctgacctagaaaatcggtggctccttctgccaggaaacgtcttgagttcccgcccatgcttgacagcctctcattggagttttgatgacttgaagtacaaggaaaccagacaggaaaggtggaacctgggcagaaaaactctttctggcttcctaaaaatgtgaaaaattaaatgggagctatctttacattaaattatatgagcattagctgagcgtggtggcaattgcctgtggtcccagctactcgagaggctgagatgggagtatcccttaagcctgggaggcagaggttgcagtgagccaagattgtgccactgcactccagcctgggtgacagagcgagaccctatctcaaaaacaataaaaataggcattaggaggccaaggctggtggatcactagaggtcaggagttccagaccagcccgcaaacacagtgaaactccaactctactaaaaatagaaaaaaaatttaaaaacaaaaataaattatatgagtagaaagaccagatagcaggctagtcttccaaataatatacttccttataagcctatgctaatggaactttcctttctattttacagggaagttttttttttttcataactaaaattttcttttcttctggcatcaaatctaccaaggaagagaaaagaggaaacacactgggtatctttttattaactcaaatattcttgatttcttggtctctaggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtgcgtaaacttgcgttggatctttcccatgtctgcaaaagcttcttatggaattatttcaaatgtgggatatgagaaaccttttctgaaaagtgttcggatagatggatgtaagagtttttcttgtaggcatccttgattgttgcttgaaatgttaacttcatgagaatgtttcaagaaatagttgtagagaaaatcttcattccctatgggaaagaaaataataaatgactagatcaggaaaaaaatggtgtaggaagacaaattctgtttgaataactaggtgggaagaaatcctttgcaaactttgaaatatattgatagtaaataatgccataaatgacctttacattttgataagggatgcaaggtctctacacagatctaaatctagatctagatagatctggagggaaggtctttttgaaagtggggcttagtaggtggctgatcctcagcgctctgatgagttttctcaaggtgccaaaatctgtggaaccatcagaaccgcgtgttttcttcaggaagctacatgcaggttgagaccttacgtactgaagagagttcagattactctacctggctccaaaacattttctttcccacaggtaaatcatgtaaaactcctccagatccagtgaatggcatggtgcatgtgatcacagacatccaggttggatccagaatcaactattcttgtactacagggtgagttggcagcaacatctcttggtttaagagttccagcacagcgatagtactttctagccacatctcagcaaggaaactaggctattgccacctgctcttaagaggcttgaacacaggtgttaactcctgattgaaatgaacaaagataggagaagattagggggaaaatctgtatccttgctggaaaccagggcagtgcacatataaagagtatgctgttcactggatgggaaagaaaaaaaattagaagtgtagtagtcaaagcacacaaacaaccctaacccagagtagacattgctggaagaaagggaagaccatgtagcagctgtgtgagagaatgaatcttaatgataacagcatgatcccttgctagggctgccatcaaaaagtacaggccttcctcgttttattgtacttcgcagatgttatgctttttacaaattgaacgcttgtgggaacgctgtgtaagcatgttcgtcggcatcatttatccaacagcgtgtgttgacttcgtgtctctgtgtagcattttgattattctcacagtatcccagatgttttcattattatcatgtctgtgatagtgatctgtcatcagtgatctttgatgttactattgtcattgtttggggtccctacgaactgcacccatataagacagaaaacttaatcaataaatgtgcgtgctttgactgctccatggactagacattccccttctgtctccctctcttcaggactccctaatccctgagacacaataatactaaaatgactccaattaataaccctacaatagcctttaagtgttgacatgaagggaagagtcatgcatctcttactttaaatcaaaagctagagatgattaagcttactgaggaagatacgttgaaaaccaagataggccaaaagccattcctcatgtgccaaacagctagaaagttgtaaaggcaaagtaaaaatacttgaaggaaatttaaaatgctcttccagtgaacacatgtatgataagaaggtaaaacagccttattgctgatatggaagaagttttagtggtctagatataagatcaaactagaaacatttcctgaagccaaagcgtaatcctgagcaaggccgtaactctcttcaattctgtgaaggctgacagaagctggaagctagcagaatttggttcctgaggtttaaggaaagaagccctctccataacataaaggtccaaggtgaagcagccagtgctcatatagaagttgcagcaagttatctagaaaatctagctaagatcactgacgaaggtgttacactaaataacagattttccatgtagacaaaacagccatctattggactttcatagctagagaggagaagccaatacctgggttcaaagcttcaaagaacaggctgactttttaggagctaatgccgctggtgactttgagttgaagccaatgttcaccgaccattctaaaaatcctagggcccttaagcattaagttaaatataccttgcctgtgtctataaatggaagaacaaagcctgatgacagaggtatgtttgcggcatagtttactgaatattttaagcccactgttgagatctagtgctcagaaaaacagattcctttcaaaatattactgctcattgacattgcacctaagcagccaagagctctaatggagatggacatggagatgaatggagttttcctgcctgctaacaacggcagccattctgcagcccatggctgaaggagtaattttgactttcaagtttcactatttaagaaatacattttgtaaggtgagtccccacagacagtaattcctctgatggatctgaacaaaataagttgaaaactgctggaaagaattcatcattctacataccattaagaacattcgtgattcatgggaagagcttaaaatatcaacattaataggagtttggtagaagttaattccaaccctcatggctgactttgagaggttcaagacttcagcggaggaaataactgaagatgtggtgaaaatcgcaagagaactacaattagaagtggagcctgaagacgtgactgaattgcgacaaattcatgatcaaacttgaacagatgaggagttgcttctcatgaatcagcagagaaagtggtttttttgaggtggagtgtcttcctggtgatgatgacatgagcattgtgaaaatgaccacaaaggatacagaatattacaaaaacttaggtgataaagcagcagcagtatcgggaggattaactccaattttgaaagcagttcagagggtaaaatgttatcaaacagcattgcatgctagaaaaatcttttgtgaaaggaagagtccatcaatacagcaattttattgctgtctcagcttaagaaattgccacagccaccccagccttcagcaaccaccaccctgatcagtcagcagccatcaaccttgaggcaagaccctccaccaacaaaaagattacaaattattgaaggtcagataatctttagtattttcttatcaataaacctttttttaaagtatgactttgtttagacataatgctatttcacacttaatagactaccgtatagtataaacacaacttttagactcactgagaaatcaaaaaattcatctgactcatttgttgtgatatgtgttttattgtggtggtctggaactgaacctgcaatatatttgaggaatgtctgtaacacgaagtgggcggcttaatacaacagaagtttttggagttccattctagagactggaaatccaaaatcaaggttttgggagggccacgctccctctgaatcctgtagggaaggatccttcattgcatcttccagcttctggagccacaggccttccttggcatgtggcagcagaactccaatttctgtctctgtcctcatatggccatcttccctctgggtctgtgtcctcatatgctgttctctctgtgcatgtctgtttccaaagttttcccttttaataaggacaccagtcacactggattagggcctaccttcatgacctcaccttaacttgattgcgtctgcaaagatcgtatttccaaataaggtcacatccacagggactggaggttaagacttcagcatactcaggggagacacaattcaacctataacagagcccctttgaaaatgtcaggcatcaggtgctcacagcacacggtccagctgttggtgctcacccttgctcagcacacggtggaggctctgcctcaatctcattcttcatgggaacagctaagccaggtagcgaatacgagttacgtttgtgtcaccacagcagacactgaaaggaagtttgtggtgtccagcacatttgccagcataggcctcacagaccacaacacctagaatctgacaaaaattagaataaatccgatgtctccttttctctctttttttaagcatttttaaatacaattggtaaatttcctgactgtaccctactcatcttgcattgctgaataagtgaggaacctctctatggcatgaagcagaaaaccattgagcttatgagaagaaacaggaaatacatgtaaaagagaccagtctgaaaaatcaggagaaattttacaaaagagatttactgccaagaaaccagggaaactttcagaacactctccttttcatatttgtaacaagattcaattgtacaaatacttctgtgaaactagccatgaagtgtgtacatgaatgaatatatgtattcagtgtgtttatatatttcatttcatacatgtgatctatatcatatatatatatatatatatatatatatatatcacaatgaatattgcagaaaattaaagcaaagagtaagaagagttaaccaaatgttccctgaatgcagtgggaaaagatgaaaaggagaagacaggcaagcacagtggctcacacatgtaatcccaacatattgagaggccggggcaagaggatcacttgagcccaggagctcaagaccagcctggacaacatggcaaaaacccatctctacaaaaaagtataaaaattagctgggcatggcagcatgtgactgtagtcacagctaggcaggagaatgaagtgggaggatcacctgagcccaggaggctgaggcttcagtgagccttgatggcaaccctgcactccagcctggatgacagaatgagaccctgtctcaaaaaaggaaaaagagaagacatatgtaacacagtgtcaggattcaaaatacatgtagcaaaaattccagaagggtaagcaaataagcccatacctagccatcactagggaaacttctgtgtttcagggatagagaaaaaaactctgattccagaaataaaatgtgaaaatataatacccgcaaaagaaataaatttattgacaccacattgattctatattgtataagatatattgtataacactaaattgtagaagatagcacttctcttgagccaagctaatatgcacacctagaggctccaggtacacattaaaggataagcaaagacacaaaaattgtaccatttaagtatgtttcccaggcaattcataagcaaatttttaaaaaggagaatgatgaattccaaaggaaatctcaatgagataggatgtaggtaaaaagaaaaaacaacaataaaaaaaacatacacacaaaatcttggcaatgtaataataatttattaataatctctctaaactcatagaatatatcaataaaactagaaaatgtgagacagcaagaaaagataggctagacttacattacagaaaagatgagtagactgactatatagagtttgactctaaaattgagaaaagaggtttaaatatgtgtcacgtgtatatgtataatatacatgcacacatataaaatgaaattcctcactggaaaaaatattaagtttaatttccaaattattagaatgactaaaacagttgaatctatctgttccatatagtaattgagggggaaggaaaaggaatagcaaggaatccatttttctcttccaccagaaataagctccctcatgtttgggtcaggtcactttattcattgctttctccacatcctcatcattaggcatcatgaaatcaatgaaaaggcagtgaaagaatgatgatgaaagctaatcaaatgtatcatttacctcaatacgtttggtttaatcttcttgttgaaagacaaattctcctagacaggatcaaaagcaacatatcttgtatttataaaaaacatgtctcaagtaaaatgacatagtattatacacacacacacacatacacacacacacacacattaagggaaaatgcagacaaaaaatggcagaaataatatttagagaaagatagaatttaagaaaaaaaattgtcaaacaggtctgcaaaataattgttttattttggtgccagttacagtccgcaatgaagcgaagatattaagaagcaaagtgggccaggagaaattagagcagaaatatctctttcaatagtgagagaataggaaaaagaagtagaaaagctgggaacaataggtaaagtttaggctaggccttagacttctcctgcattgtaatccctctggtttgccacatatgcatgctgtcaggaagttgatgaggtatgtacagcacaatttattttccattttttgcctttaggcaccgactcattggtcactcatctgctgaatgtatcctctcgggcaatgctgcccattggagcacgaagccgccaatttgtcaacgtgagttgaaatctctttccccattcaccccaccgtttaatcctagagttgtcctcctagaattacaaagaatggatctcatccctcttggaaatggtatccttctcatatttgaagaatccagtcatatccttaaaatggctcacagcattccaaacttccaccttcagctagaaatgcttttttattttttcttatctcaaggtctaattttttttaaactagtctttagctcacttaaacagtcccccaatttcatcctctgttgggtgaacacctcccagtttaaagagcattttatttagtgaagtcaacaaatacaaagtcagtgaaagaaaccccatatcctctctgcaagctcttagtatcacatcagatattcaagccatgcagctctttcttccttcttattctttgtctaaacaggatcatgccatcttccctgtgagttgtttggaagatgagctttctacattttggggagcaaagacgaatgagcaattgcaagctaacaaggaatataaaatgtgtataatcctgggtttagtgatggtgtgaggaaatcagcaatttcaaacccagttggtgggaggataagtgggaacaaactttgtagaaggccaataaactggctgggcactgccctacggtagagtaggacacagtattcagttcttccaagatcagacgagattgggcgcatttagggtggtatggttgtagatcagtatccagttctttttattatttctgaatctgtaagtatcatgtttattatatgtaatattgtatatttgtactttgtctttgttagttcttccagagcttttgttcttattatttaataaagatgttatactgagccacatgtggtgactcaaacgtgtaatcccagcactttgggaggcctaggtgagcagatggcttgagtccaggagtttgagaccagcctgtacaacatactgaaacgctgtctctacaaaaatacaaaaactatacgggcatggtggcacatgcctgtagtcccaactactcaggagactgagaggtgggaggattgcttgagccagagaggtcgaggctgcaatgagccatgatcgtgccactgcactccagtctgggcagcagagcaagaccttgtctcaaaaaaaatgctatgctgtatgctttattatattaatatccaatagaataaagacacatgccttctatatagagagaactaaattaataatggtgagataacagttaaattctcatttagcaggagaaataaaaacatagactataggctaggcacagtggctcatacctgtaatcccagcacattaggaggctgaggtgggcagatcacttgaggtcagtagtttgagaccaccctggccaacataatgaaaccccgcctctactaaaaatacaaaagttagccgagtttggtggcgcatgcctgaaatcccagctactcaggaggctgaggcaggaaaatcgcttgaacctgggaggcaagggctgcagtgagccaagatcacgccactgcactccagcctggggaacagagtgaggatctgttaaaaaaaaaaaaaaaaagtggactctaataatacatggacacatttagtgaaataaacttaactgagtagagcagaacttataatattttaaaactgtaagaacatgtctgtacattagcaaatagtagatgagaatagtattttcaatatttacttctggtaatttggaattaaaaaaaaaacttttgggaaaatttacaataaagtatgattttaacaaaccaggctaggcgtggtggctcacgcttataatcccagcactttgaaaagcagaggcatgcagattgcttgaggccaggagttcaagactagcctgcccaacatggccaaaccccatctctactaaaaatacaaaaataaaccagacatggtagtgcatgcctgtgatcccagctactcgggaagttgaggtaggaggattgcttgacctgggaagtggaggttgcagtgagccatgatcgtgccactacactccagcctgggtgacagagcaagactctgtcccaaggttttgttttggttaacttgctgtccctttttccaggaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccaggggtgagtctgactgaggcctagtagggccctgcaagtgacatgcgttgctgttggatcaggagattagtatttgttcacggggagggatgtgtgctgagcagggtcgaggagcaaattttctaagtagtgaacatgaaattcaggtgtgtagacatgtacatgtgctgaaattgagaagcaaagctcaacctgggcaagggatatgatgtttctttggggttcttataaacagatctatcaattacctttgagtataataatgtttgatacaaaatgagtgattcctctgcccaggcactataatacaggctacatgtgaattttaatcctgaaaacaaagttattaggtagttcccagttgttctatgtttgtctgttttgttttgcttgagatactgtcttgatctgtcactcaggttggactgcagtggtgccatcatggcatacttcaccctccacctccctgactcaagcaagtctcctgcctgagcctcccaagtagctgggaatgtaggtgcatgccaccatgcctggctaagttttttatattttttttgtagggacagagtctcaccatgctgcccaggctggtctcaaactcctcagctcaagcacccacccaccttgggctcccaaagtgctgggattataggcatgagccactgtgcccggcctctatgttttacagagaatatgtgccttagacacatcagataacattctgagacagtaacttgcagacaaaactggattgcaagtccacctcactccagagccttggctttgctcatcagcattcagtcatgaaatcaaaacttactctagatactttcaaggagggagggatttcatgcaggttgtattagtctgttctcacattcctataaaaaactacttgagcctgggtaatttataaagaaaagatgtttaattgactcagagttctgtaggctgtacaggaggcatggctgggaaagttacaatcatggtggaaggcaaagaggaagcacgcatatcttcatatgcttggcaggagagagagagagagcaaggcagaggtgttacagactttgaaacaagcagatcttgacagaactctatcacaagacagcactagggtgatggtgctcaaccattagaaaccacctccatgatccagtcacctcccaccaggctccttctccaacactgggaattaccatttgacatgagatttgggaggggacatagagccaaaccatatcgcagctaataggtcacaaaaatgttagaagggcaggaaaagcaataggacaaaggcaaagttacgagagatcagggagctgctgtggctcccagtctacagcacaggagcctggagtgatggtgaaatggccagcccctcccactgagcaggcagctccctgtaagctgctaatactgcaggagccaccattgctgccagaatgcagctgatattgctggagccaaagtcattggcatcgttacaattgaagctgtagctactcactgaagccatctatactgccactgcctgagccacttctagaagtagaacagattctgccatcatcctgctttttaatttggtatatatgcctccaattggcagaacctaaccagagcctagctatcaaggaagatgaacgatttatttttaaggcctccattgttagctgtcaaaagacagtgcagaagtgtgaggctgggggccaacagaaatttaaccagcacagcacctcaatattacatcaccaggcattgattagtccagggaaacactgggtgatgagccctgaaaatggacattacagcatcagagtatttacaaactccttaaagaagtcatttttctattccaatcccccatttgatgcttgagaaagctgaagtccagaaaagggaactgatctgctcaaagacaaactgaaattactttttccattttataacagttttatgtaatttatttgagatccaaatgtgttttgatttcccaagatcagatcaactacattaagagagagcctgagatgccgttacaatatgttgtgtgaaattacactctcattatggtgacagtaggtctttcagattttgttcgacagtttcccaccttctcactgaagtgaaatgaatgactaggcagcacctgctacatagcatgaagagaggagacccatagttctttaccaccctatgtcaggtggccgctgagagaagacttgaaaggagatgagcatagatgtatggacgctctttgttgcaccagtgtgataggtgatggagggacctattagatgggacatgggcaggggcactcctttattgcttaaaatgcaagactaaattggtgatgcctttctagaaaggaagtatgaagatacaaaaatccatcattcctcccaattttgtactgggtgaacagtaattggaagcattctagaaggaactgtccattgtgaaatcttagttgcatactttagatgaaaaacaatgaattggagatacctctgttttagtcacagttgtgccatgtgtcagttctatgactgatggcaagacatcttccttgccccgtgtatttagtttatcaatgtaataaggctgttattctaactttattattatatatagattcgtaattattattcccttggccagtttaacagtgagaaaaaagttgttttcacacaattagctgtactttgtttctctctccccagtatgtcagccacctccagatgtcctgcatgctgagcgtacccaaagggacaaggacaacttttcacccgggcaggaagtgttctacagctgtgagcccggctatgacctcagaggggctgcgtctatgcgctgcacaccccagggagactggagccctgcagcccccacatgtgaaggtgactagactcttatctggcttgatatttttagcttgcgtctttattctccacatgccagtgatttctgttcgtttttctttatctccagtgaaatcctgtgatgacttcatgggccaacttcttaatggccgtgtgctatttccagtaaatctccagcttggagcaaaagtggattttgtttgtgatgaagggtgagtatgagcttgcctgacctgctggacattgaaattggggttgggaatcagtctaaaaaggggagatttggtgtggcttaaaagaaagacacacacacacacacacaccttcagagagatgaactttcgaaagtatacctaggaagaaaggaaagaaacatatagaactaataacatgagatatgaagaggaaactggaacatatattaactggcaagttcaaaggcaagtataactagtggttatgaatatataggtaacacattaagcaaaaaatatcagccaggcacggtggctcacgtgtgtaatcccagcacctttgggaggttgaggcaggcagatcacctgaggtcaggagttggagaccagcctggacaacatggtgaaaccctgtctctactaaaaatacaaaagttagctgggtttggtggcatgtgcctgtaatcccagctactccggaggctgaggcaccagaatcacttgaacctgggaggtggagtttgcagtgagccgagatggcaccattgcactccagcgtgaacaatgagtgaaactccatctcaggaaaaaaatcatattttacaagcaaaagggaatatgagtaatttagagagtcccaggaaaaattgcaagtaatgaaaagcttattattaaaagctaggatcctttaagaatcatttcagtaaattctttaaaccatcaacagtgaaatttgtaataggactgaaaatgtaaaaatcagcatttttttaaaaattcagtcatatatcttctggctagtcatgggctctgggctctgagctggggtcgtgatggctgctgttaatattcccagcaaggtcattaccttgtttatgtccatctagtgctcttcacagcgtgcacatctctacacaggagctgaccggcatgggcaacaaagcacctgatcccataatgtaacacagaatcttggcagcctccaaatgccagcacccagtaagagttaggagggcatcagggtccaaaagactgagaattttcgacaattgcatacaaaaatcatgtcctctcttctttcctttttcccctagaatattcatgcttactcttcagcagcccaaactgcccttttgagccttcttcacgccatcacagatgtggagatgaaaggacaatctctgttctctcgccagctatttcccacttttccactccaaactgggagctgttttacttgctgttccagggtcagagttaggaaggcattacattagaagactgggtttctaataacaacaatgagtgatttatcaggttatcatggagtaatcagtgaaactccaagcctgggtcctgggtcaaggggatggcgcctatgtcatgaccacctttttcaattcaagcaggactatcatgtgaccaagctactacattttgccattctatattgttcccttctggaggctgtgatttttccagaataaggtagcctgtgcaactctgccatctgctggcctcagatcctcaaaatcctgaaattggggctgggccttagattgtgaactaagtgtcctcttggctgaaacagctcactattcactcctattttcttctttagatttcaattaaaaggcagctctgctagttattgtgtcttggctggaatggaaagcctttggaatagcagtgttccagtgtgtgaacgtgagtaataggagcaacatttcaggccaatctctccccttcatctgttcactatttgtcctatggcctccctcaatgtgattcttcaatattctagtcttaattatcgatttaaaaatagtttattttaataatgtttggttgtgaatcaatatgtacatcacctgtctttgcaaccatctgatctgtctctgtccttctgcattctctgttctagtgcgataaatcctttggtcttgtgctcctaggtcaggagagattagataatgtgaagctttaacaattttctttctttctctagttttttctttcttttttctcttccttccatccttcagttctttcttcccttcttctctccttctcccctttcttctttccttcctcccttctttctttttcattttgttctcccatcaaagtgcagtcagtctacaatttatatatatatgataatacacaaatattgaacatggctttatttaatcaatatttattgatcacatactttgtgcctgatgttcatctagccactggagttatatcaatgaacaagatggatgaattccctgtccccatgttgtttctacttaggtggggagagggacaagaaaaaaaataaattcaatgctatgagacaatagagcaaagcactgaggaatgaggcaaaaatggggagcaacattagacagggtgagcagtttgagactccttaaattctcaaaacatgtacctaaataatttatgctgagagattcataaataataagtcatttttttaaaatgagcctcatatgttcaataatcagtagactactgatttctcctagtctacccatgtataatttccccaatggaagatagaactttgcttcaattcttgattctaatgattggaaaacgtgtttctttagaaaatcatgaaattttactaaaatgtttatgttgttagaaatatacttggacatcttacagtgatttttagagtaaaattttggaagaacataacttatatagagattcttgctgtctaagaaatccagtgctccttgaagcagtatgacaagtgtctgttctactatcatgaatgaaagctcattaactggactactcaagctttctcttatttttcataactcttgctagttaaaatagtttcttccaaatgccagttctaatgaaaaatgccaattagaaatgaggaagagactgttctaaacaaatcattagatgctagaaaggagtaacaacttgaaacctgacccagagagtaaaaagagaaaataaatcatcaacagacctagacattttcaaaagcaaagccatctgaatccatttggagttttttttttttttttatcatggcctgactatgtttcaattcactgtgacagggctattgttatcactgagattgatgatcaatatcaataagtaatcagtgaaaggtttcacctatttaagatgattagcacacatatatacatttgagaaatatttcctaagaatgtaggctccttcctcagcgctgtgtccccaggatcctgatgaagggctgacacaggataagtgctcaattaatatatattgactaaatgaataaataacccttcaaaatggttatttttcttcttcaaatgttttgctacttcattaaagttgtaaagtttctactgtccaggaactgttactatccggaagattcaggatagacaaatctcttttgtactttgcaatacattttcattgacatctcatttaatccaactcttcaaagtcctaatgtctactgtcatctccttagcatattttcagcaacaccaatcatagcaccctgtaattgcagaatacctctggtgaaactcctgaatgaaacttagagcttttgtatgttttctagaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggttagtgctcatttccccacatccctaatgggttcagaatatctaacccagcccctccatatttccataattacagtgtagtatttatttgtatgtatgcatttgccacaatggaatgccaaaccaatgatagatggttctaaggtaggtcaacacataagatcctgatgacctttgcagatggagggactgatgaaaaaagagggaggcggtgagtggtgggaaagtccttcattagaatcatatgaattaaaaacagatgcctgtgaatctccttattgaaatgtttggtttagaaatctgacctagaaaatcggtggctccttctgccaggaaacgtcttgagttcccgcccatgcttgacagcctctcattggagttttgatgacttgaagtacaaggaaaccagacaggaaaggtggaacctgggcagaaaaactctttctggcttcctaaaaatgtgaaaaattaaatgggagctatctttacattaaattatatgagcattagctgagcgtggtggcaattgcctgtggtcccagctactcgagaggctgagatgggagtatcccttaagcctgggaggcagaggttgcagtgagccaagattgtgccactgcactccagcctgggtgacagagcgagaccctatctcaaaaacaataaaaataggcattaggaggccaaggctggtggatcactagaggtcaggagttccagaccagcccgcaaacacagtgaaactccaactctactaaaaatagaaaaaaaatttaaaaacaaaaataaattatatgagtagaaagaccagatagcaggctagtcttccaaataatatacttccttataagcctatgctaatggaactttcctttctattttacagggaagttttttttttttcataactaaaattttcttttcttctggcatcaaatctaccaaggaagagaaaagaggaaacacactgggtatctttttattaactcaaatattcttgatttcttggtctctaggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtgcgtaaacttgcgttggatctttcccatgtctgcaaaagcttcttatggaattatttcaaatgtgggatatgagaaaccttttctgaaaagtgttcggatagatggatgtaagagtttttcttgtaggcatccttgattgttgcttgaaatgttaacttcatgagaatgtttcaagaaatagttgtagagaaaatcttcattccctatgggaaagaaaataataaatgactagatcaggaaaaaaatggtgtaggaagacaaattctgtttgaataactaggtgggaagaaatcctttgcaaactttgaaatatattgatagtaaataatgccataaatgacctttacattttgataagggatgcaaggtctctacacagatctaaatctagatctagatagatctggagggaaggtctttttgaaagtggggcttagtaggtggctgatcctcagcgctctgatgagttttctcaaggtgccaaaatctgtggaaccatcagagccgcgtgttttcttcaggaagctacatgcaggttgagaccttacgtactgaagagagttcagattactctacctggctccaaaacattttctttcccacaggtaaatcatgtaaaactcctccagatccagtgaatggcatggtgcatgtgatcacagacatccaggttggatccagaatcaactattcttgtactacagggtgagttggcagcaacatctcttggtttaagagttccagcacagcgatagtactttctagccacatctcagcaaggaaactaggctattgccacctgctcttaagaggcttgaacacaggtgttaactcctgattgaaatgaacaaagataggagaagattagggggaaaatctgtatccttgctggaaaccagggcagtgcacatataaagagtatgctgttcactggatgggaaagaaaaaaacttagaagtgtagtagtcaaagcacacaaacaaccctaacccagagtagacattgctggaagaaagggaagaccatgtagcagctgtgtgagagaatgaatcttaatgataacagcatgatcccttgctagggctgccatcaaaaagtacaggccttcctcgttttattgtacttcgcagatgttatgctttttacaaattgaacgcttgtgggaacgctgtgtaagcatgttcgtcggcatcatttatccaacagcgtgtgttgacttcgtgtctctgtgtagcattttgattattctcacagtatcccagatgttttcattattatcatgtctgtgatagtgatctgtcatcagtgatctttgatgttactattgtcattgtttggggtccctacgaactgcacccatataagacagaaaacttaatcaataaatgtgcgtgctttgactgctccatggactagacattccccttctgtctccctctcttcaggactccctaatccctgagacacaataatactaaaatgactccaattaataaccctacaatagcctttaagtgttgacatgaagggaagagtcatgcatctcttactttaaatcaaaagctagagatgattaagcttactgaggaagatacgttgaaaaccaagataggccaaaagccattcctcatgtgccaaacagctagaaagttgtaaaggcaaagtaaaaatacttgaaggaaatttaaaatgctcttccagtgaacacatgtatgataagaaggtaaaacagccttattgctgatatggaagaagttttagtggtctagacataagatcaaactagaaacatttcctgaagccaaagcgtaatcctgagcaaggccgtaactctcttcaattctgtgaaggctgacagaagctggaagctagcagaatttggttcctgaggtttaaggaaagaagccctctccataacataaaggtccaaggtgaagcagccagtgctcatatagaagttgcagcaagttatctagaaaatctagctaagatcactgacgaaggtgttacactaaataacagattttccatgtagacaaaacagccatctattggactttcatagctagagaggagaagccaatacctgggttcaaagcttcaaagaacaggctgactttttaggagctaatgccgctggtgactttgagttgaagccaatgttcaccgaccattctaaaaatcctagggcccttaagcattaagttaaatataccttgcctgtgtctataaatggaagaacaaagcctgatgacagaggtatgtttgcggcatagtttactgaatattttaagcccactgttgagatctagtgctcagaaaaacagattcctttcaaaatattactgctcattgacattgcacctaagcagccaagagctctaatggagaaggacatggagatgaatggagttttcctgcctgctaacaacagcagccattctgcagcccatggctgaaggagtaattttgactttcaagtttcactatttaagaaatacattttgtaaggtgagtccccacagacagtaattcctctgatggatctgaacaaaataagttgaaaactgctggaaagaattcatcattctacataccattaagaacattcgtgattcatgggaagagcttaaaatatcaacattaataggagtttggtagaagttaattccaaccctcatggctgactttgagaggttcaagacttcagcggaggaaataactgaagatgtggtgaaaatcgcaagagaactacaattagaagtggagcctgaagacgtgactgaattgcgacaaattcatgatcaaacttgaacagatgaggagttgcttctcatgaatcagcagagaaagtggtttttttgaggtggagtgtcttcctggtgatgatgacatgagcattgtgaaaatgaccacaaaggatacagaatattacaaaaacttaggtgataaagcagcagcagtatcgggaggattaactccaattttgaaagcagttcagagggtaaaatgttatcaaacagcattgcatgctagaaaaatcttttgtgaaaggaagagtccatcaatacagcaattttattgctgtctcagcttaagaaattgccacagccaccccggccttcagcaaccaccaccctgatcagtcagcagccatcaaccttgaggcaagaccctccaccaacaaaaagattacaaattattgaaggtcagataatctttagtattttttatcaataaacctttttttaaagtatgactttgtttagacataatgctatttcacacttaatagactaccatatagtataaacacaacttttagactcactgagaaatcaaaaaattcatctgactcatttgttgtgatatgtgttttattgtggtggtctggaactgaacctgcaatatatttgaggaatgtctgtaacacgaagtgggcggcttaatacaacagaagtttttggagttccattctagagactggaaatccaaaatcaaggttttgggagggccacgctccctctgaatcctgtagggaaggatccttcattgcatcttccagcttctggagccacaggccttccttggcatgtggcagcagaactccaatttctgtctctgtcctcatatggccatcttccctctgggtctgtgtcctcatatgctgttctctctgtgcatgtctgtttccaaagttttcccttttaataaggacaccagtcacactggattagggcctactttcatgacctcaccttaacttgattgcgtctgcaaagattgtatttccaaataagatcacatccacagggactggaggttaagacttcagcatacttggggggagacacaattcaacctataacagagcccctttgaaaatgtcaggcatcaggtgctcacagcacacggtccagctgttggtgctcacccttgctcagcacacggtggaggctctgcctcaatctcattcttcatgggaacagctaagccaggtagcgaatacgggttatgtttgtgtcaccacaacagacactgaaaggaagtttgtggtgtccagcacacttgccagcataggcctcacagaccacagcacctagaatctgacaaaaattagaataaatccgatgtctccttttctctcttttttttaagcatttttaaatgcaattggtaaatttcctgactgtaccctactcatcttgcattgctgaataagtgaggaacctctctatggcatgaagcagaaaaccattgagcttatgagaagaaacaggaaatacatgtaaaagagaccagtctgaaaaatcaggagaaattttacaaaagagatttactgccaagaaaccagggaaactttcagaacactctccttttcatatttgtaacaagattcaattgtacaaatacttctgtgaaactagccatgaagtgtgtacatgaatgaatatatgtattcagtgtgtttatatatttcatttcatacatgtgatctatatcatatatatatatcacaatgaatattgcagaaaattaaagcaaagagtaagaagagttaaccaaatgttccctgaatgcagtgagaaaagatgaaaaggagaagacaggcaagcacagtggctcacatatgtaatcccaacacactgagaggctgaggcaagagtatcacttgagcccaggagctcaagaccagcctagacaacatgacaaaaacccatctctacaaaaaagtataaaaattagctgggcatggcagcatatgcctgtagtcacagctaggcaggagactaaagtgggaggatcacctgagcccaggaggctgaggcttcagtgagccttgatggcaacctgcactccagcctggatgacagaatgagaccctgtctcaaaaaaggaaaaagagaagacatatgtaacacagtgtcaggattcaaaatacatgtagcaaaaattccagaagggtaagcaaataagcccatacctagccatcactagggaaacttctgtgtttcagggatagagaaaaaaactctgattccagaaataaaatgtgaaaatataatacccgcaaaagaaataagtttattgacaccacattgattctatacaacactaaattgtagaagatagcatttctcttgagccaagctaatattcacacctagaggctccagatacacattaaaggataagaaagacacaaaaattgtaccatttaagtatgtttcccaggtaattcataagcaaatttttaaaaaggagaatgatgaattccaaaggaaatctcaatgagataggatattggtaaaaagaaaaaacaacaataaaaaaatacacacaaaaactcggcaatgtaatcataatttactaataatctctctaaactcatagaacatatcaataaaactagaaaatgtgagacagcaagaaaaggtaggctaaacttacattacagaaaagatgagtagactgactatatagagtttgactctaaaattgagaaaataggtttaaatatctgttgtgtgcatatccatgtgtgtaatatacatgcacatatataaaatgaaattcctcattagaaaaaataataagtttaatttccaaattattagaataactaaaacagctgaatctatctcttccatatagcaagtgagagggaaagaaaaggaaagacaaggaatgcatttgtctcttccaccagaaataagccccctcatttttgggtcaggtcattttattcattgctttctccacatcctcatcattgggcatcatgaaatcaatgaaaaaggcagtgaaagaatgatgatgaaagcaaatcaaatgtatcatttatctcaatacatttggtttaatcctcttgttgaaaaacaaagtctcttagacaagatcaaaagcaacaaatcttgtatttataaaaaacatgtctcaagtaaaatgacatagtattatacacacacacacacacacacacacacacacaaattaagtgaaaatgcaaacaaaaaaaggcaaaaataatatttagagaaagatagaatttaagaaaaaaattgtcaaactggtctacaaaataattgttttattttcgtgccagttgcagtccacagtgaagccaagatattaagaagcaatgtgggccaggagaagttagagcagaaatatctctttcaataatgaaagaataagaaaaagaaatagaagagctggaaacaataggtaaagtttaggctaggccttagacttctcctgcattgtaatccttctggtttgccacatatgcatgctgtcaggaagttgatgaggtatgtacaggacaatgattttccattttttgcctttaggcaccgactcattggtcactcatctgctgaatgtatcctctcaggcaatactgcccattggagcacgaagccgccaatttgtcaacgtgagttgaaatctctttccccattcaccccaccattgaatcctagagttgtcctcctagaattacaaagaatggatctcatccctcttggaaatggtatccttctgatatttgaagaatctagtcatatccttaaaatggctcacagcattccaaacttccgccttcacctagaaatgcttttttttttcttatctcagtctaatgtattttaaactagtctttagctcatttaaccagcccccaatgtcctcttctgttggttgagcacctcgcagtttgaagagcattttgtttagtgaagtcaacaaatacaaagtcagtgaaagaaaccccatatcctctctgcaagctcttagtatcacatcagatattcaagccatgcagctctttcttccttcttattctttgtctaaacaggatcatgccatcttccctgtgagttgtttggaagatgagctttctacattttggggagcaaagacgaatgagcaattgcaagctaacagggaatataaaatgtgtataatcctgggtttagtgatggtgtgaggaaatcagcaatttcaaacccagttggtggcaggataagtgggaacaaactttgtagaaggccaataaactggctgggcactgccctacagtagagtaggacacagtattcagttcttccaagatcagacgagattgggcgcattcagggtggtatggctgtaaatcagtatccagttctttttattacttctgaatctgtaagtatcatgtttattatatgtaatattgtatatttgtgctttgtctttattagttcttccagagcttttgttcttattatttaataaagatgttatactgagccacgtgtggtgactcaaacttgtaatcccagcactttgggaggcctaggtgagcagatggctttagcccaggagtttgagaccagcctgtacaacatggtgaaatcatgtctctacaaaaaatacaaaaactaaacaggcacggtggcacatgcctgtagtcccaactactcgggagactgagaggtgggaggattgcttgagccagagaggtcgaggctgcaatgagccatgatcgtgccactgcactccagcccgggcagcagagccagaccttgtctcaaaaaaaaatgctatgctgtatgctttattatattaatatccaataccataaaggcaaatgccttctatatagagagaactagattaataatggtgagataacatagttaaattctcgtttagcaggagaaataaaaacatagactataggctaggcacagtggctcatgcctgtactcccagcacattaggaggctgaggtgggcagatcacttgaggtcaggagttcgagaccagcctggccaacatggtgaaaccccatctctactaaaaatacaaaagttagccgagtttggtggcgcatgcctgtaatcccagctactcaggaggctgaggcaggaaaatcgcttgaacctgggaggcgggggttgcagtgagctgagatcacgccactgcactccagtgtggggaacagagtgaggatctgttaaaacaaacaaacaaacaaaaaaaaaacacatggactctaataatacatggatacatttagtgaaataaggttaactgagtagagcagcactcataacattttaaaactataagaacatgtctgtacattagcaaatattagatgagaataatattgtcaatatttacttctggtaatttgaaattaaaaaacaaaactgttagcaaaatttacaataaagtataattattagaaaccaggctgggcacggtggctcacgcttataatcccagcactttgaaaggccgaggcaggcggattgtttgaggccaggagttcaagactagcctgcccaacatggccaaaccccatctctactaaaaatacaaaaataaaccagacatggtggtgcatgcctgtgatcccagctactcgggaggttgaggtgggaggattgcttgacctgggaagtagaggttgcagttagccatgattgtgccactgcactccagcctgggtgacagcaagactctgtcccaaggttttgttttggttaacttgctgtctcttttccaggaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccaggggtgagtctgactgatgcctagaagggccctgccagtgacatgtgttgctgttggatcaggagatgagtatttgttaagggggaggtatgtatggtgaggagggtgggaaagtaagttttgggggaagaagcatgaaattaagaattgggggtgtgcatgcacccatgcatatgtgtcttcatttggaaagcaagaccttaattagccaagaaaaaagctattttggactcacctattatttgattctcagggcaaagtaccagctgcaatctctctcaagtatattgaaaaattatatggactttctctatgatcagctatgtgctaagcactttatatgcattttctcattcattatttacaacaacactttgaaattgtgctattgtattatccatttaatagtgacatcagcttgatctttcagaggttaaataaattagctaagtcacatgttctaagcgagacacccaggattttaaaatgcaagtgtatcagaccccagagtctgaatgttttggctcttgccatactttcatcagtatccattgctgaaagaaagagactggcttacaaagacagaaatcatagcctcagaatagacaaagaccttagagtttgtctataatggtctgcctcctacattttattttgattttattttatttaaaaactatttattagagttgatgtcccactctgttgcccaggctgaagtacagtgatacaatcatggctcactgcagcctcagattcctaggctcaagccatccacgtcctacattttatccctaggagtctaagtcaagagtgaaagtaacttgttcaaagtcagttaaatatttctaaattcatgtttaatgaggtatagattaggttgatgttaaaatgggttctgatgccctaagcatgaacgaacaggactataaataaaggcagatgttgagtcaaatactctccaaataatatgccctctcgtgacaaaggactgtcttatttaatggcttgtgtttttgatggctcatcttgtctactgatgccacaatagctggcttagcagctgtgtaggaggtgttatggttgatacatagggacagagaaggagcttacgattcttctaccaacccatgttagccttgtgcaaccactgagctgggaagatgaacagataaagggatataaagacggatgtactgaggcaggagatgggcagggcttgtgttctggtcacaatcctgctgaccaaaacaggctctggcccagacaggatgaagtgaaaaaacagcaggaaccagcagatggcgatgaaagcaattgctagctgccctcatagtcccatcagcaccatgacagtttacaaatgccatggcaacgacctagaagttaccgcccctttcctggaaagttctaaataactcgcccctcaatctgcattgatccactccttaatttacatgtaactgaaatgggtttacagcagtataaacacagttgcctgccaggaacccttatgttgctgactctgggtgtgctgcctgtgagttagccctgctctgcaagaagcagtgcctttcactaacagattgctgtctagcaccactggctcatccttgaattctgtcctggatgaggcaagaacccttccagagtaagccccaatttaggggcatgcctgtcccgaaacagtatgactgtactttagtcattggtgtgcaatcagagaaattgggggaaatctgtaaaacagatttggtctcaggtgacagtctcattacctgaataacaatggtacaaatcgggattaccttcctaggaaatatgtagatggagaatccaccaatactgataacttcacattggatagccagagctaggagaaaatacctcatgccctgtagatttacaagtgaatttggggccttgtgctagggagaattgggttctatttctctacctctgactagctatgaggtcttcaggaagcataggaaattcccccataactaacaagtactctggaactgtcctttccacagtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcaggtgcctcaactctctggcttccagatttctctctttaccccacacatggaggtcttactcctattttttcttttttttttttttcttcttctagtgaaatcctgtgatgacttcttgggtcaactccctcatggccgtgtgctatttccacttaatctccagcttggggcaaaggtgtcctttgtctgtgatgaagggtaagtgtgacccagaattcagatcagggactcagcactgcagagtgactcttgagcttaaggatcaatccaaaaagagggctgacctaggagaagaagaatccagggagattaacctctggaagtgtagctttaaaataaaggtagggactaagtggcactactatcaggagataaagagataaagaaaaaatggcgcatataactgagtgtcaagtacaaacagaaatacagtcaccagtccagaaaaggggaccaacctggtggaaaagaagtactagaggagactaatatctgaaacaatgattggaaagtgtggtatgaaccagctggatccatgaacagaagtttaaaaagcaaaaagctcaactcatttgatttctcacttatagaggctcagaagtaaaatcattttggaaaacgtgcagcttccagtaaggcacaaaggaaaaacaatggccgaaatacaaaagatcttgaaaaaaaaagtgtgtatatatatgtatacatacgtatacatatggacacgtatatgtatacgtatacatgtacatgtgtatacatatgtgtatacatggacacgtatatgtagacgtatacatatggacacgtatatgtagacgtatacatatggacacgtatatgtagacgtatacatatggacacgtatatgtatacgtatacatatggacacgtatatgtatacgtatacatgtacatgtgtatatgtatacgtatacatgtccatatgtatacgtatatgtatacatatgtatatatacatatgtatatacatatatatggaacatatgtatatatacatatgtatatacatatatacatggaacattagatgtatgaataaataataatttgcagacatgaagagataaataaatattctaggggttgttaagaaaagtttgatatataagagaaagttgtatataagataaaataacatgcaaagattatttcacaaaacttttaatcaaataaatagtggaatttggaataggaacgaaagagtaagtagaaatattctaaattccaattacatgtgattgacagctctgccagctattattgctttgtcctcactgaaagctacactttttccaaaatgatttggcttctgagcccgtcaatgagaaactaagtgagttgagtgttttcacctgtgctttagcttgagcagtaaaatgttaattaacttaggaattctcagggaggaggttgagatctgtcacgaagggaagagagaaatggtgcattcatccagccactactgctttgttctttaggtttcgcttaaagggcagttccgttagtcattgtgtcttggttggaatgagaagcctttggaataacagtgttcctgtgtgtgaacgtgagtagatggaatacttgttcagtctggatctttctgtttttttcttaatatagtttgccccatgggattatctattgtttgtcccgctgtttgtgcccgcttttgatagaaattgttctttgttggaatagatacaagcaatgttttggggaaaaataaacatgagaatcatgtgttttgggtaccatcctataaatatttatgaggagagtctgtgctataaatagagagaaatgcttcatagaaataaatgtatggcaagatgctaggctaaatttttctcttctttcctgtcaaaagtaatagtcatacttcaacttttcagttcttccctcaatcatccatttagtcatatactcattctttcaacagaaaattatttgagcacctactatgtgccaagcaatcttctgggaactggggatatacctataaacaagacagataagtccatgtttaagtttttgtgcaaggataaagacaaaaatcaaagacatgaatagaaatgttcaaatgatactaagtgttattaagaaaatgctcttaattgagtcagtgctgtcaattgagaatgtagctgaggacccaaaaggcaagtgtagcccagcaaacctctgggtgtagctgagggttcaaaatgggaggctgttgcagcaatctaatcagagatgttggcccaggatagcaattgggaaaggtgatgatgagaagtgatcaaattctggatatattttgaaggtgcagatgacaggatttggtgatggttagcttagatagagggtgtgaaagaaagagaagaaacatagccagtttccaggtttttggccagagcaaccgccagggtagaatttcccttagctgaaatgcaggggactgcatgaagtttgggaatgggggaaatcaaaagttaagcttgggacataactttagtgttcctcttagatatccagatggatatgttggagagtcccaggctgcccatagatatgtagaagccatcattgtatctgctatgcttgaaatcaggactgaaagagatcttcacctagggagtgagtgctgctagagaacagatgcatggactgagcctggatgtccaggattaagagttgcaaaggtgagaaggaatcagcaaaggggattatgatgaagcagccactgcagtaagagaaaacacaggagggtgaggtgccctggaagccaagtatggaaattattttaagggattagactaatcaactgtgtcaaattctatagagaggtcaaattaggtgagaacagaaaattgatctttgggtttagcaacttggaggtaacaagtggaagtttcagtggagtgctggcaaacactgattggaatgaattctagggagaatgaatgggaggaactgtaacagatcatagacaatattttagaggagttttcatgtaaagagagtagaaataggactatagctgaagagggaaatgacagcaagaggtttgcttttgatttttaagagggcagaaaatagtgtgttaaaaacagaaacactactatgtcccatctatccatttacttcttcactaaatcaatcagggtattgcttccccttctgatcatagctattaaaaatacatgtttacaatagaattttgctcatatgaatactttgccttaaatcatttcaatgtcttgtattgatttatatgatgaaaatgataatttcatcttacattgttggaagtcagctatttgacaatcttaacttccctggaatagttaagaagtatgaaagaaaagaaaaagaaaataccctcatgaacccaacatatacctgaaatcgcttactagagtgtaaacattggttaagctattttaacctttgattagtttatctataattcttttaagctgtaatatcctcttcccaaattcaaagcaaattagaaaagggaaggagtgtccccaaatagaggcattccaaggaataaatgtgtttctttaatgaaaaaaataaataaataaacccttaaaaaccaatgagtatctcaaaaaaccgtaacattcttgagccttttgaaacacatacaggagtacatagcatttttttttcattgtgacagcattactgcaatctttcatctgtattttgaaaatcatagcctggcatcatcaagaaaaattaaatcactgatatacaaataataaatgtataatatattttagaaagatgtctctaggatgaagactcttgatgtcaaagatcatatttatcctgtgctttaaacagtacttgacatacagcagatattcaaaaacatgcttgttgaattaatggatgattcccctttaatgtgactgtgaagatttttatttactttaaaggaatatactctttattattcagaaatattaactatctgaaaaatttaggatgcttaatttgggaaaggcttttgtaataaacattgatttagttgtcatttcatttagctccatcttagcagaggcctaatacatttattttgcagtttctactttccttaagaagaaaagtacgcttaattggcaacacagtcacagtatgacaactgtagaatcaccttggattatactttaaaattttttatggaattgagagctcttgttttctttctagatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcagtatccacttccacatatcctaaatgggttcagaatatgtggacccaatccctcatgtttctgtaataagactatggtatttgtttgtgagcttaactttgtcataagtgtaaatgtcaaaattacataccatagctaaaacagatgggtttcagcagcgccaaggtatgtttgaatctataagatgaaaactcttcttgctggtggagtggaagagggtgggaaaaagggactgagggaggggtggagggaaggcagtaaggcacagttatgtaaatcaggaagaaaaatgtattcactggagacgacatgaaaacatctgcctctgaacactaaccagtatctgtataattgacagtctccataagttcatgaggggtacatgggcatgcaaagttcaaaattggaaatgtggatattatttagctaaggttttaaactagtgttctgctgcatgggctaagtaaccaaaaagactctctttgtcttgacttaaagtttgtccacttgtcatcttgcctccaggctgtcttaatctttgtacttgaactgttccactcagggggtaagaagcaaggaaagagtagcccaaagaaaagagtaggaaaaggaagaggctatttcttcctaaggaggggaagaagttgcctggtccttcagggcaaacattaggccttttccagagcagaaactggagtagattagggatgtggcaccagccttggaatattccattatccacagggaagccctgagagacaagagccagccaaggtgaaaagactaaacctgatgaaaggcatttaacctttctttgacctttactctccaactgagtggtacccatcagaatgcagtaaatttttttaatgtaaatgcctagaccccagtgcaggcttaatgaacagatggaggaagccttctccaaaaaggaggtaatggagttcagactctatttgaaaatatgcagcacatggctgggcacagtagctcacacctataatcccagcactttggaggccgaggtgagaggattgtttgaggccaggagttcaagaccaacctggccaacacagcaagctcctaactctacaaaaaataagactgaaaaattgtaaaaactgtaaaacaaaaaaagtaaaaatatgcagcacacaatatactctctcagaaagaagacatagcttcttacagaaggctgatggcttagtctgttttgttctggttctttttttgttttgttttgtgtgtgtgtgtgtgtgtgtgctttttttgagagagagggtcttactcttttgcccaggtggagtagagtggtgcaatcatagtttactgcagccttgacctccctggctcaagcaagcctcccatctcagcctgccaagtaggtgggaccacaggtgcatgccaccacacccagctaattcttgtattttatgtagaccggttttcatcatgttgcccaggctggtcttgaactcctgggctaaagcaatccacctgccttggcctcccaaagtgctgggactacaaggcgtgagccaccatgcccagcctattttgttctatctttaaatgcctggtttagcatcagaagaaaaacactgtattagtttcctagggctgctgtaacaaattaccacaaactaggtggcttaaaacaaaagaaacttattatttcacagttttgtaggctgaaattgagatgttggcagaggtattttcccatcttctaaggctctggaaaataaccaattctttacttcttccatctgctgctggttcctgggattccttggcattccttggtttgtggatgcatcattcaaatccctgcctccatcatagccttttcccctgtgtctctatatgtcaaatccctccactttttccctgatagggacaccagtcattggatttagggcccactctaaataaaagatgatctaatctcaagaacctaatcttaattctatctgaaaaaccattattccaaataagtttctattctgaggttttaggtagagatatcttttgggagaacatcattcaactcactacaaggggtacctgctatgaaaggccagagaggcagcttatgatgggcaccctgagaatggagtatggagagagatgataaaatatgtcttgctactcatgagtgaattagcacaaacacatgaagatttgagtggttaactgaggatataggcactccgataggaggtcagaatgtgaaactacaagctgaagttcttgctttggtgaaataagggaagaaagatcagaaagctgagtggtcttccaaatagtaaaaaaaatcctgctgagtagatgcattgaagagcttcatcccaaggtaacatcaaggagaagaaaatcttttgctattcttgtaagtctctttgtttctgtgatccacctatcagcttaattgaagagaaagaggaggtagggtggaagtctctctgctaactttgatattcctgtggtttttctctccaggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgtgagtaacccctccctgggaactacttcatgtctgttaaagcataggtgggaccgggcttggtggctcacgcctgtaatcccatcactttgggaggccaaggctggcagatagcttgaactcaggagttcgcaaccagcctgggcaacatggccaaaccccacgtctacaaacaacaacaacaaaaacaacgtaggtgggatttgattcaatttgctcaaattttggaagcaagatgtctatatttgcccaagatattttgataaaggaaaggatggtcttgtacatcaccccttcttcttgcttgtagttcctgaaccttgactagatgctcatttcatgagaatggctctcacaaaagaattagagagaaaatttacattcactgtagatcatccttgatggctgacaccattaaatgaatgaaacaggggtacaaaagaaatttatgtgagttgcagtgaactgtgcttggctaactaaaaataggggagacatcccaaattttgaggcctttgattttggctggcggaatgagagtacaacactttagccataaatgacttgttttgtttttgttttgtttctgctgttgctgttgtgttttttgtttgtttgtttgtttgtttctgagatggagccttactctgtcacccaggccggagtgtagtggcgcgatcttggctgcaacctcctgggttcgagcaagtctccctgcctcagcctctcgagtaactgggattacaggcacccactcccatgcccagctaatttttgtattttttagtagagatggggttttgccacgttggccaggctggtcttgaactcctgacctcaggtgatctgccggcctcggcctcccaaagtgctaggattacaggcgagagcccatacataacctttattaggaggtgcaagatagtctttttcaaagttgtgttcgtagctacatgattctgaagttgtctgccaagtttcctcaaagcagtcaattccatgaaacaattggaactgtatatgctgtttagtatgccacactccagtctgaaccttacaaaggtaagttgaactctatatttaatcccaaattctgcttcttcccctaggaaaatcatgtggacctccaccagaacccttcaatggaatggtgcatataaacacagatacacagtttggatcaacagttaattattcttgtaatgaagggtgagttgagaataccatctcttgaatatgagttccagaacagcagagccaacttctgacccagtctcagatagacaaactaaactattgctccctttactttaaaagcaagcaataggacttatagatggagatgatacgttggacatagccatatgatcaaaggaatacaaaaaagaaggtacaatatgtattgtattgtaaaccagaggagggcaacatgttcctgtcaaaggtggtacatgtgaaacctggtcaggcattcattggatgaaaaggagcagcttacaaataaggaaaaggaaaaaaggtagttgaaccatgtaaacctccttaactgagatcagtaggtaatacagttgagttggaggaccctgaagcagagtttgggagggtaaacattaattgtaacagcagctctggaagagtatgcatcaaagtgcacacagagaggagacattatggggttcttgctcttgacttctccttgggacaagtagccacaccaaaagccattgcctcaactgagaaggggcttttaaaaactctggagtggacctccatcaaactccagcagacctgcagcagaggggcctgactgttagaagataaactaacaaacataaaggaatagcatcaacattaacaaaaaggacgtccacatgaaaaccccatccaaaggtcaccaacatcaaagaccaatgatagataaatccacgaagatgaggaaaaaccagcacaaaaaggctgaaaattcccgaaaccagaatgcctcttctcctccaaaggatcacaactccttgccagcaagagaacaaaactgggtggagaatgagtgagttggacagattgacagaagtaggcttcagaaggtgggtaataacaaactcctctgagctaaaggagcatgttctaacccaatgcaaggaagcgaagaaccttgaaaaacaggttagaggaattactaactagaataaccagtttagaaaagaacataaatgacctgatggagctgaaaaacacagcacaagaacttcatgaagcatacacaagtatcaatagccgaatcgatcaagtgaaacaaaggatatcagagattgaagatcaacttaatgaaataaagcatgaagacaaaaaaagaatgaaaaggaatgaacaaagcctccaagaaatatgggactatgtgaaaagaccaaacctacgtttgattggtgtacctgaaagtgacggggagaatggaaccaagttggaaaacactcttcaagatattatccaggagaactgccccaacctagcaagacagtccagcattcaaattcaggaaatacagagaacaccacaaagatactccttgagaagagcaaccccaagacacgtaattgtcagattcaccaaggttgaaatgaaggaaaaaaatgttaagggcagccagagagaaaggtcgggttacctacaaagggaagcccatcagactaacagtgaatctctctgcagaaaccctacaagccagaagagagtgggggccaatattcaacattcttaaagaaaagaattttcaacccagaatttcatatctagccaaactaagcttcataagtgaaggagaaataaaatcctttacagacaagcaaatgctgagggattttgtcaccaccagacttgccttacaagggctcctgaaggaagcactaaacatggaaaggaataactggtaccagccactgcaaaaacataccaaattgtaaagaccatcaacaatatgaagaaaccacatcaactaatgggcaaaataacaaatcagcatcataatgacaggatcaaatttacacataacaattctaacattaaatgtaaattggctaaatgcccccagttaaaagacactgactggcaaattggataaagagtcaagacccattggtgtgctgtattcaggagacccatctcatgtgcaaagacacacataggcgcaaaataaagggatggaggaatatttaccaagcaaatggaaagcaaataaaagcaggggttacagtcctagtctctgataaaacatactttaaaccaacgaagatcaaaagagacaagagcattacataatggcaaaggatgcaacaagaagagctaactatcctaaatatatatgcacccaatacaggagcacccagattcataaagcaagttctgaaagatctataaagagacttagattcccacacaataatagtgggagactttaacaccccactgtcagtattagacaggtcaacgagacagaaaattaacaaggatattcaggacctgaactcagctctggaccaagcagacctaatagacatctatagaactctccaccccaaatcagcagaatatacattcttctcagcaccacatagcaattattctaaaattgaccacataattggaagtaaagcactcctcaaaatgcaaaagaatggaaatcataacaaacagtctctcagaccacagtacaatcaaattagaactcaggattaagaaactctctcaaaactgcacaactacatggaaactgaacagcctgctctgaatgactactgggtaaataacgaaatgaaagcagaaataagtaagttctttgaaaccgatgaaaacaaagacacaatgtaccagaatctctgggacacagccaaagagtgtttagagcactaaatttatagcactaaatgcccacaggagaaagcagaaaagatctaaaatcgacgccctgacatcgcaattaaagaactagagaagcaagagcaaacaaattcaaaagctagcagaagagaagaaataactaagatcagagcagaactgaaggagatagagaaacaaaaaacccttcaaaaaatcaatgaatccaggagctggttttttgaaaagattaacaaaatagaccactagccagactaataaagaaaaagagagaagaatcaaatagacacaataaaaaatgataaaggggatatcaccactgatcccacagaaatacaaactaccatcagagaatactataaacacctctacgcaaataaactagaaaatctagaagaaatggataaattcctggatacatacaacctcccaagactaaaacaggaagaagtcgaatccctgaataggccaaaaacaagttctgaaattgaggaagtaattaatagcctaccaaccaaaaaaagcccaggaacagatggattcatagctgaatcctaccagaggtacaaagaggagctggtaccattccttctaaactattccaaacaatagaaaaagagggactcctccctaactcattttatgaggccagcatcatcctgataccaaaacctggcagagacacaataaaaaaggaaaatttcaggccaatatccctgatgaacattgatgcaaaaatcctcaataaaatactggcaaacaaaattcagcagcacatcaaaaagcttatccacaacgatcaagctggcttcatccctgagatacaaggctggttcaacatacgcaaatcaataaacgtaatccatcacattaacagaaccaatgataaaaaccacatgattatctcaatagatgcagacaagggcttcgataaaattcaacagcccttcatgctaaaaactctcaataaactaggtattgatggaatatgtcccaaaataataggagctatttataacaaacccaccactaatatcatactgaatgggcaaatgctggaagcatgcgctttgaaaaccagcacaagacaaggatgccctctctcaccactcctattcaacatagtattggaagctctggccagggcaatcaggcaagagaaaggaataaagggtattcaaataggaagagaggaagtcaaattgtctctgtttgcatatgacatgactgtatatttagaaaaccccattatctcagcttaaaatatccgtaatctgataagcaacttcagcaaagtctcaggatacaaaatcaatgcaaaaatcacaagcattcctatacaccaataatagacaaacagcgagccaaatcatgagtgaactcccattctaaattcctgcaaagtgaataaactaccttggaatacaacttacaagggaagtgaaggacatcttcaaggagaactacaaaccactgctcaaggaagtaagcgaggacacaaacaaatgaaaaaaacatttcacgattgtggataggaagaatcaatatcatgaaaatggccatactgcccaaggtaatttatacagtcaatgctatccccatcaaattaccaatggctttcttcacagaattacaaaaaaaaaaaaaaaaaaactactttaaacttcatatggaaccaaaaaatagcccatatagccaagacaatcctaagcaaaaagaacaaagctggaggcaccacgctacatgacttcaaactatactataaggctacagtaagcaaaacagcatcgtactggtaccaaaacagatatatagaccaatggaacagaacagaggcctcagaaataatgccacacatctacaaccatctgatctttgatgaacctgacaaaaacaagcaatggggaaaggattccctatttaataaatggtgttgggaaaactggctagccagatgcagaaaactgaagctggaccccttcctttacatcttatacaaaaactaactcaagatgtattaaagacttaaatgtaagacctaaaactataaaaaccctagaagaaaacctaggcaataccattcaggacataggcatgggcaaagacttcattactaaaacaccaaaagcaatggtaacaaaaaccaaaattgacaaatgggatctaatgaaactaaagagcttctgcacagcaagagaaactatcatcagagtgaacagacaacctacagaatgggagaaaatttttgcaatccatccatatgacaaaggactaatatccagaatctacaaggaacttaaacaaatttacaagaaaaaacaaccctatcgaaaagagggcaaaggatatgaacagacatttctcaaaagaagacatttatgcagccaacaaacatgaaaaaaagctcatcatcactggtcattagagaaatgcaaatcaaaaccacattgagataccatcttgggccagttagaatggcaatcactaaaaagtcaggaaacaacagatgctggagaggatgtggagaaatagaaatgcttttacactgttggtgggagtgtaaattcgttcaaccattgtggatgacagtgtggtgattcctcaaggatctagaaccagaaataccatttgacccagcaatcccattactgagtatatacccaaaggattataaatcatccttctataaagacacatgcacacgtatgtttattgcagcactgttcacaatagcaaagacttggaaccaacccaaatgcccatcaatgatagactggataaagaaaatgtggcacatatacaccatggaatactatgcagccataaaaaaggatgagttcatgtcctttgcagggacatttatgaagctagaaaccatcattctcagcaaactaacacaagaacagaaaaccaaccaccgcatgttctcattcctaagtgggagttgaacaatgagaacacatggacacaccgaggggaacatcacacagtggggcccgtcagagggtaggagtccaggggagggatagcattaggagaaatagccaatgtagatgatgggttgatggtgcagcaaaccaccatgacatgtgtatacctatgtaacaaacctgcacgtcctgcacatgtatcccagaatttaaagtatgataataaaaaaaagactgtgtactcatttttggttgccatgataaattcagagaggaaaaacatgatatatattaaattttactgcaacaactaactgccccttgtcatcagcctattctgtcactagagtgagtcagtattcctcttttctgactgtctgagcctggacgatttaaactgcttttcacacaacctcttgcccaaccttttctcacctcccattgtgaatgaacatagatttccctatggtaaacaaaacaaaatatcaccaaatctaaggcaagataaagaaattgaagataaaagaaaccaacccaagagatcagagaaatattcatctgcacaacagcttcctccaataaacaggggacaatctttaaaaatctctcatatgtgtttgtaacatagaatcgatggaactatatgaggcatttataagatttaatgatctgatatcagaaaagttgagatttgaatgaaacacatgggagtcggaaaaggagtgatgactggtagattggagcctgcccccaacccccggaaaaaaaaaaaaaaaacaccaaagggataatgaagacaagattgaattctccagaattcatcaaggaccagacttgaaatgacacatatatacacacaaacacactacacacaaacacacagggatataatatagaaattccagaaaaaataaaagaaagcagaatgaatagaagcattaattagcacataatggaagacaatttctcaggctataaagaaaaatactaagttgatccttgaaggcttactagacaaatcaagattaacaacaatgggccccggccctacatggaagaaaattatgccatccaaatataaaaaaatactgccactctccagaaataacaaaaaagaagaaattcatcttagcaccaagcttccgttctgtaacactaagtagtagaagttagtgtttgagaggaaatattgtacaataaaatttctgtactcggccaagctgccattcatctgcaaggcacagatgcatcgtcttaaataagaaggaaccccaaacatacaccagttagatatactgcctacaaaaagaaaaactcccacaaagctgtgggagtttttctttttgaagaagaaatcaaaattccaaatggtgttgtatcaaagaaatattaatgaggcacaaaactagttaaatggggtcactaaaactgttttatttaatatggaaataaaatatcaaagcaggactaattcttgaaagataattcatgtaatatgaaaagaagaagaaacttgatataaaaaatagattttatcacttcagctaggaagttagagatgaagtaagaaaaaccatcataaacttatcatatgtaggggacacatattcttgacataaaaaataaggagaaaatggtacttcacaccagtataaaatctatatatctatatctatatatatctatatctatatctatatatatatatataatcaaattttaaaagataatcagaagggcgaaaccacttggtccataaaacaaaagaggggtgagagaaacaagagctagcaagctttctgtctctcttttgggaaactagcattattacgttaaagtgaattaatacatgtattttaatgcctcagtttttctttctaatataataaatattaacagatataaactccattggtaaaatcactttgaggtccttaatacttcttaaagtggccgggcgctgtggctcatgcctgtaatcccagcactttgggaggctgaggcgggcagaacacctgaggtcgggagttcaagaccagcctggccaacatggagaaaccctgtctctactaaaaaatacaaaattagccaggtgtggtggcgcatgcctgtaatcccagctactcgggaggctgaggcaggagaatcacttgaacccgggaggcggaggttgcagtgagccgagatggtgccactgcaccccagcctgggcaacaagagcgaaactctgtctcaaaaaataataataataataataacaataacaataacaaaaatgtttaagagtgaaaagaattcttgagaccaaaaaagtttaagaactagggcttgatgatgttcaagcaaagataggaaaaggctattgcaagtacggtacaaagcacagggggaaggtttcataagtatatatataatatatatataatataacataaaattcatatatattataaaaataataaatatgatataaatttgatataaaatattatataaatctgatttttaacatattttgattttatactggtgtaaagtactattttctctttattttttacatcaagaatatgtatcccctacatagtataagtttatcatagtttttcttacttcattcctaacttcctagttgtagtgataaaatctattattttatatcaataaaaatattgatataaattttatttacatgatatacaatatttaaatataacatattttatattacaaaatatactactatgtattacaaaaaaaaaaacaaactccatttagcagagcaagaatggagtttgttttgtacagtgctgagttccaacccatagaattgttaaataaataaaaaggaaagaacactataagatcaaactcatcagttataatagtaaatgtgaatgattccaatccccccttttgaaagacaaaggcttctaaatatggtcagaatcctatttacagtagcaccaaaaagaataaaatacttaggaatcaatttaatcaaggaggcacaagacctgtgcactgaaaactcagtaactgaaaatgagcaaatgatgtgatagacatgtctccaagggaaatatacaaatgcccaataaacacatcaaaagatgttcaacatcattagtcattagggaagtgcaagtcaacctgactttgtactaggatgttttgtattaggatggttataatatttttaaaaaataggaaataaaaggtgttggcgaggatgtggagaaattagaacgcttatacattgctggtggaaatgtaaaatggtgtagcactgtggaaaacagtttgatgattcctgaaaaagttaaacatagaattaccatataaccagcaattctgctcctaggcatatacctaaagaaattgaaaacaaggactgaagcagatgctcaaataccaatgtccgtagcagctttgttcaaaatagccaaaaggtagaaacaacccaagtatctacgagcagatgaatggataaatgaaatggagcttatccattccatggaatattcttcagctatacaaaggaatagagttctgatacatgctacaagatgcataaactttaaaaacattatgctaagtgaaatgagccagacacaaaaggataaatactgtattccacttttatgaggtgccaaaaataagaaaatttattggactaaaaatagattagagataaccagtggaaggagagaatagggagttacaactcaatacatccagtttctcattgggatggtgaaaatttttggaactaagcagtgataatggttgtataatgttgtgaatgtcattgatgccactgaattatacccttaaaatggttttaatggcaaattttatgttgtatctcttttaaaacaataagaaagaaaaaaatttttaaatatatcatgtgatattaggaaagaaaaaaacagataacagtataagaaaaataagaatttaaaacatatcaaataagatttaaaaattttgtttaagatattgatacttggtccagtgcacaataaagacaagaacttttttttttttcttttgagatggagtctcgctctgtcaccaggctggagtgcagtggcactatctcggttcactgcaacctccgcctccagggttcaagccattatcctgcctcagcctgccgagtagctgggactacaggcatgcgccaccacgctgagctcatttctgtatttatagtagagacagggtttcaccatgttggccaggatggtcttgatctcttgacctcgtgatctgcctgcctcggcctcccaaagtgctgggattacaggtgggagccaccgcgcctggcctgaagacaagaacttttgaacaagagagcgctaactaacgtattgaaatacataaaacaaatactgatatatagaagagctcattcagctgtttcaaagacagagctctgtaacacatgtactcttacctaaagaactgtctcccaccactggaaaggaggtcttctctgaccaaatacacagcatcttggagttggccagcattaacttggatcatctggctggccaggaaaggagtgctcagggagaaagaggatggtcaccatcccaaccagattggccattagatctatgtatcaacagagtgacatacgggagaattaaaattctagtatgcaaaaatacaccgtatgttaacagaaaatagactgcagggaaatttgtattaggtaaaaccgagagaaagttaagagcatacaacagtagataagcaatagacaacccgatataaaaatgaggaaagaatatgcacaggcaattcacaaaaggaaacataaaaatggccttaaaaattgctaaaataaatatttaagcaaaaaagctcaacttcactatggtttggggaaatgcaaattaaagcaacaatatgtcatgttttcacagtcacattaataaaagtttaaaagacggaagtagaggtaaataggaatttgaggaaaaggagccctctcatagtggttcattggaatgtgaattgctgcagctttcaaaaaaaaatcttacactatccacaaacaatgaaagcatagatatcttcttagctactaatcccactcctaggaaaaggagtattaattacaataggttctttattgcagtattgtttatataagcaaaaagagcaaacaaccttgacatccttctattagcagtaggttgaataaatcataagacgtctactatgaactattttgcagcaatcaagaagacttaattagatctctgtttagtgatttgaatgggtgaccatgttgtgatgtcaacagaaaaaaataatttgcagaaaagcatatagagtttgttctcaatttggaaaaataatgacaaatttggaggagatatcctatacacatatgtgtgtttgattgggtttggaaaaatcaggaccacctgagatggaggtgggagtgacaaaatatacatggtatactaagtgaatatataggttatacaattacgttgttaaatttctgaaaacaagtgcaacttaagcatataactaaggagtagatgttaacctggacaaatgaaacatagattgttttgagcaagagacggcaaaattttttgtcaagagccagatagcaaaattttcaattttgcagaccatgcaatctctattgcaattactcagttctgccattgcagtggaaaaatagccctagacaaatgaatgtgtgattgtattttgataaaacttcatttacaaatacgtgctatagaacaaatttggcctgtgagccatagggtgacaatctccggttagatgaagggattgagagcattatttttcttcaattcttgtcattatgcaaagtcagagaattttctaaaataaataaaaatacaaattggcaaaataataatagttgaaaacttcagattgggcaaataagtgaacaaataatcacatgttgaggaataaggctgctttgattcttgtgtgttcaactttgaaacctttatcacagttataaaaaccatttataaaagtgatataactccacagagtatacctcaataaatttgcacatagaagaaatcaaaatgggtatattttctcatcgcaatacaccaaaaactaggaattaataagcaaatgatacattaaaaattcaaagttttagaaaacggagtaccttagatcttgatcaaagagaaatttaaaaacagccattgcagattacctggagaataacaatcgctaatgatcctcaagtgcatgtgcctcaagcattcttctaagtcctttacttgaattgatttacttagtctttaaaagaccctttgaaatggatatcatgcatatccctcattgtatagaagagaaaactgagacagacaggttaactaatttgtccaaattcatgtgacaggttgaggttagaattagaatatcgccagtcagcttcaacaacctgtaatggtaagccttacattatttatcttcttaattaggaatgctgaaacatatattactcataaaaatttctggggtgctgatgccaaaactgtcctcagagaaatttttcaatcctttttgttacttgacaggaaaaaattcaaataaatgaacaaaacatttcttaacaatttttaaattattaaaaacatatataaaaggctgctggagtaaggaattaataaagtaatgaacaaagaaaaaatcatagaaattataaagaaatctaaaagcagattctttaaagtgaccaattataaaacaaacagactgggtcaattgtcatttcacaaaataacaattctataaatatacaagaatgagaaagaagacataagcctgttgatattgaagagatttaatacttgataaaaatattatatcttctctattctaataaaattaaaactatccatgaaatgtaccatgtcagaagaaaaatacaatttaccaggtgtagtttaaaataggcagaattgctgataaacccatatctgtttgagtccatattttcaattcttttaggtatatacccagaagtggaattcctgggggatatggtaattctgtttaacttttcaaagaattgccagactattttccacagctgctgtaccattttacatccccatcagcaatgcacaaatgttccaatttctctacatcctcaccaacacttgtcatttttctggtttaaaaaaaattattattataccaccctaaaaggggctgaagtcagtttgatttacattttcctaatgactaatgatgtggagcatcttttcttgtgtttattggccatttgtatgtcttttttggaaaaatgtctattctcatcctttgtccatttcgtaattgggttgtttgtttcattgttattgagttacaggagtcctttatatgttctaagtattaaatccttatcagatagggttttcacatattttctatcattctgtgggttgtctttttaatctcttggtggtatcttttgttcttgacttggactgcaggacacttcagttcctcactacatgggcttctccaaaggacagctggcctctcccagaatgagcatctcaaaaagagaagaaaacattgcagtgctttttgtggttagcctctgaagttgcacactatatcatttccactttattctaatcattagaatcaagtcacaaagcacagcccacattcaaaaagagaggaattgggctccatcacttgaagggacatgtataaaataatttgtggacatatttaaaaccaccacaaagaagcacctttaaaaaaagacaatggcccagttttgtaactcttttttaacttcaagaaatagataatccaagtattaatattatttaaactgttatggaacatagaaataaaattatagccataattaaagtttgccaaagattacaaatgaaaataaaataaaatatatctctggctcatttgctaatataaatactaaaaatcttaaattgactattaaataaaaccaatattaaaagaattatgcaaggggaacaagtaaggttattccagaaatggttccaaattaggaaacccacaaacttacaatattaaagagtacaacttttcttaaatgtcatataaatatactctctaatgccaaaaaacacaatgaatggttaaaatctaaaagcatgcttgaatataattaaagttcaaaggaaaagaacactcggcatccttcctattattcaaagtagttgtggaaattcaaaccagtaaaatgacagccccctgtatttagagagatatacatatagatatagatagagagagagagaaggcaaatttattattaactgatggttgtttacctgaaaacccgaaggaattatttgaaaggttattagaataggaaatggtagtgagatatcgagtaaaaaataaatacttataaattaattactttctttatgtaggtaacaaccaaatagaatataaggaggaaaaataccattcacaacagaaacaaaatcatctagaaagaaatttaacaggaaatatataggacttataagcagaagatttaaaagagggggacatagaaaaatacttcaagaaatggaagatataatattttatttaaaagatttaatgttgtggtgatgttaattatccctgaattagtatgcaaatttaatgtaatcagtttcaatgacattcttttttttaatttgacaagatgtctgtaaatgtcatgagacccaccaacagaatattctgagataataacaagaagggtgtttgataccagatcagaggtgggtttgatacccacctctcagtgtctggtaaccacctttctactctctacttctacgagttcaactattttagatttcacatgtaagaaagatcatgcggtattagttcttctgtccctagcttattttggaaggtattttaaggcacaaatatgttgtagtgtaattatgttgtaatttttcctgacctgatgtcccacgtctgtaaaattcttttattgaagcctaggctctttccctaggactccctgtctggaatcataaatatcttacttctgtacttaacagaattgttctgtctgcatatagtccccactttttctccaagtagtttctcaaacaaatgcacttcctttcctgaaaagatgagtaagattttaacagctttaaatctttatatatagatatattttaagccaaacgactacactgtacatggttttatagccctctttaatacttacgaactatattgtataattattctaattattatatattactctacaacaccatttttagtggttgcattttggttattacttggatagtccataacctacctaacaaagtccttaatgtctggaattaaagtggtttcgcatttcaactgttagcaaaaacactacaatgcacgatcctgcacacgtgaaaagaaatgagatgaggacttcactaacttcaaagacagcttaaggattcagatcttcacatgtacacaagagacaagatttgcagatttgagtgaaaggctatgcacgattttaagcctttcagtacatattgccaaagtgccctccactaaactttgaccatgacctacggagtgagtcacaacagtgactctttctttgagtttatattactgctaggttttgtcaatttgccaatctaatgggcaaaaacggcattttatttgcattttaaagtgtatttatcatgtttataaggaagctaaacttttcatatgttcatttgactatttccatttttcgtttgtaaattatttgttcataattctttaccatttttctacttgggtgtttgcctttttataattgatgtataagagttgtttttattatttttcctctgtggtttgtcttcaaatttgtatgtagaaaggtttatttgtaattattcagttttatcagttttgttcatagtagaatttttcctcaatgtatgtctatagaagcctcaaatcagaaacacgtttgcctaaatcacctagttcttttatggttttatttttgacatttaatctttgatacacacggattttgctttgatgaatgtcatgaggcagagatctagcttagcttttcagatatttgccctatcaatgaataattcagttttccgtgtcttgaaatgccatctttatcactgccaatttcttacaaaaacttgtatctatttcttgggctttcccccattttgctctagggatctgtgtctctattcctgcatcatttcaattattttacattttaaatgcattttaacatcccttctgtttttgtgccttaaaataccttccaaaataagctaggcacagaaaaactaatgccacatgatcttacttccatgtgaaatctaaaacagttgaactcatagaagtagagagtagaaaggtggttaccaggcactgagaggtggggagctgagatttggtcaaagggcgcagggtttcagttagacaggaggagtaagtttcagagatctattccacagcatggtgactatagttaataataatgtgtatttccaaattgctggccgggcacagtgtctcatgcctatagctctttgggaggctgaggcatacgaattgcttaagcctagaagttagaaactaggctgggcaaaatggcaaaaccctgtctctaccaataaatacaaaaattagccaggcatggcagcgcatacctgtagtcccagctactcgggaggctaaggtgggagaatggtttgaacctgggaggcagaggttgcagtaagccaagatcacatcactgcactccagcctgggtgatagatccagaccctgtcaaaaaaaaaaaaaagaaagaaagaaaagaaaaagaaagggaaaaaaaattgctagaagagtagattttaaatattctcaccacacacacacacacacacacacacacacacacaaaacaaatatgagaggtgacggacatgttaattagcttaatttaatcatttgcaacagaaacatatatcaaaacaccacattttaccctataaatatatacaattattgtttgttcataaaaataaaatcagattttaaaaaatattcactgtgtttttttcagccatacataggctggaaccttcttcacattttggctccaacaatctagcttagtcacagcgagcacatctaaaacaacctctaggaggccaaaagtcagaggactcccatgatcctgtgctcttagacaacttttaaatgtatgataggagacaggcagaggaaaacacaggtaataatgggattatccttttctttcctttctccagtggttctcaacttgtttaattgcagcaatttttaagattttttttcttggcacacttgaaaagattgtataccatagcctaaacaggctagcaataagtaaaattcaatcagtacctaaaacgtaaaagagactcactgtgtctacaaaaacattgacggtcattgccatagtcacacagttccctttagctttctgtcactgtttcgggaagagctggtatatcagttaggatttccagctgtaaaagacagaagaaataaaataacaggatctcaaacatagatagtagtttacttctgtctcaggttaaaaatcacgaaagtaggcagtccagggtttatacgatgactccataatccacagaaacctgggttccttccactttgctactctgacctcttcaaaatgagagcccatcttatctcatggtctaaactccagccagtatagaggacacagggaagaagggaaggccaattcctttaaagacactttccagaagttgcacaagacactccacttacatcctctggccagaagttagtaacatggctatgcccggctgtaaggaaaggtgagaagtgaaacctttattgcaggtggccaatggcccagttaaaaatagagggttccattactaatgaaggagaggaaagtggatactagggatggcaccagtagtctttgctacaaatggttactgccctgatcacatttcttacataatcaagaggaaaagttcttaactgttgcagttactgcctcatcattatatggcattccattttaccctttaatttttacttggtcaagtttaggcctgctgtacaccagaacacatgaatagctttgctcagcattctttgtgacgttgctcacagtaacattatggatacctaataaattttttaaaagacaaaatgttctacgttttgtggcctactctggatggctttaaggtaaagtgggtgagtatccctaccctttacatttcaagtgtaggggtgtttagctgtctcttctggctctcatttactgactcttctgggtaaatccattgttctttcttttatacaagagactatctgagcacccaaaacttgaaagtctctaagctaggtgctatagtgttaaatatttcagtaagatattttccctgcttaatccaggagcttgtcatttccttgctggaagtacacatggataaaataactgcaaggtttctgaaagacttaagtacaaaaatgtcctgcaaagaaaaagggaaatatctcattcagttgtgagggattaggaataaaaatgaattggagaggtcaaaatgtaagcttgtcctcaaaaagaaaggactaatttgcagatggagatggggtttcttccttccgaggtctgccatggtgtaatctgtcctgtaatgtctaatgtctacctgctattattttctaaatggtgagttaaatgggaaatatgtgtagcgtataaccattttctatcctttgctttaggtttcgactcattggttccccatctactacttgtctcgtctcaggcaataatgtcacatgggataagaaggcacctatttgtgagagtaagttgaaatacttttctccacaaattcctctgtgtgatcctgacttgcccctggagtacaaagaataaattgaatccttcttgcacaaagtagtctctcagatatttgaaaataggagtcagatgcttcatggtcttcctggcttttctttatcttaaaaggtgatttatctgaaactgtgggcttgaacctaggcaaaataccctactttcccattataatagtaaatatttccagtatagagagtgttgtccttaatgagtacattttaaaggcgttagacaaaattagatctgtctttgccaactcttactatctatcaggttacaattccacaaagtaggctactcactttcttgttattctaatccaaataataaaaagaactcttcttccagttcttagcaattttcctaagcctctgatcattttgagttctaatcctccttcaattcttttaggcccatgtcttcagttgtatttgttctcgattagctgaccctccatttttcccataagatatttttcaatgaatctccaaaactttaaaaccatggaagaatgattgcaaattggcaaagtgttatagctgtgaagaagtcgtcatcgcacacagagttgatggcagcaaaagtaggcacagacttccagaaagctaatgaccaatataaacaaaagtaaagtaaataccctctgactgacaattccatttcccagaatttagcccaagaaaataatcatgaaatagtcccatgattttggtccagagatactcaatgcaataatatttgtgatagtggaaaatgttaaacaacctaaatgttcagcatggtttgaaaatagctagtagaagaaataaggcatattttaatggctatcagtttttcggaaaggtaaaaaagtgcaccaggaggaattaaaggttgagatgcctcatccaagtggaaaaagtacatctatgtagctacatgactgattattattcagccaccaaatatggtagtatagaaaatatatccatccatacatatgcatgtatccacatatgtatctaagaggatataattaaattgttacaaatagttatctttgaaccattttcactttcttctttctctttgtccatattttataaatttcctacaatgaatgtgttcattgtagtcactaatattcttcccccccaaattaacattgacttttaaacattaaatgaatgagaatgtatacaaggtgcctcccatatctgccaagaacttgaaattctatgaaataattcaaattatcaaagaattatcagtttactatacaaagttttcaaggcatggcaccttttgtagggggttatcttttataaaaaaatttccacttctacatttataggtcagtgatcatttaattgagtcaatactggttatgtgtgtatatgtgtgtagtcacttagccaatatgtgaatattattatcttatgatagaacacagtattcatttatcattttattgcccttaaatctgccattatttcatttctcatgccttatcttttgtgtttccttttctctctttttcttcataaataatgccagaagtggtatatttaaactgcaaagaggttattttaataacctataggaaaaaatagtccagcaatagataagtaccttaacaatctgtgataaaatcacatgtattatccacttaaaattataaatatataaacccaaaaaaacatggattttttttgtgaaatatgagcagaacccatatcatacacacctaaatttcaactaggtaaaaatgtctgattattagcaaatattttaagaaaataacagtattgtaattccatttagaaaatcattggattatttgcatttggtatttaaattcatagtaaaataattcattattaaaaaataagctgttttaccatactcttccttctctcagtcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttctttaccctcactgagatcatcagatttagatgtcagcccgggtttgtcatggtagggtcccacactgtgcagtgccagaccaatggcagatgggggcccaagctgccacactgctccaggggtgagtgtgacccatcaagactttgctgggtgtgagggtacgtatagatgataggagttgttgaaattaaggaagaagtgtataaggactatgaaattggcataaacataatagtagcttcactgtctgttatctctgttaataattgtctcaaagtaatggcttattctctcatctatagtagacatattttagatgcatttttgaatttaacatttacagcaaatatatgaagtagctactattggtatccccattttactttgagagaactgagtcttagtgatattaaagaacttttccaaggctctgactccagagcctaatcataatgtacagtggaatgtatcatgaacaataatgtgtaatagtgatgatcgtatctctatccctggagtggggcagtaggcaagtgagccatgaggaccaaaatgagagcatcaaatcaaaaaggccttggacttcaacttcaactttttctcattataattgaaaagactgaagctcagaaaaagtgttttgctcaaatccaaacaaatatatatatatgtatatacacacacacacatatatacttgatatataattatatattgttcagattgaggctcaaattcattctttgaggttttttgattgtttgtttgtttgtatgtttgtttgagagaaggtctcgctctgttgcccaggctggagtacagttgtacaatcatagttcactgaagcctctaactcctgggctcaagtaagacctctgcctcagtctcacaggtagctggaactccaggtgctcactaccacacctggctaatttttatttatttttagagacagagtcttgctatgttgcccaggctgatcttgagctcccgtcctcaagcaatcctcctgcctcagcctcccaaagtactgggatttcaggcctgagccaccatgcctagtttcaaatgcattctgatgccctgagaacacaccaattgtcctgtggatggaggcagccaacatttcggttaaaatacggtctaagcaatatgttctatcactaaaaagtctgtagcttttttttctttgagggggggttgttctttttgtttatttttaatttattaatctttaatttttgtgggtacatagtaggtgtatatatttatgggtatatgaaatgttttgatacaggcatgcaatgtaaaataatcatggagaatgaggtatccatgcccttaagcatttatcctttgtgttacaaataatccaattacactctttcatttttaaatgtacaattaagttattactaactatagtcaccctgtcatgctatcaaatactacatcttattcattctttctttttttttttgtacccattaactgtccccacctcccctccctaccctcaccccctatccccacgattttgttcttgatgcctcctcttttcttagctgaaatgactggcttaaaacatggagtgggaagaattaggactggtcacagggacagaaaggaagctaacagttcagccctgtgctgactgaaagagggtcagggagtgtggaaaatgaagaatacgtgaaggtgtctgttagatgagaccttggcaacagtactccttgctgttgccttacgcatgagcttgagggactgcctctgtaggaagtggaagagtggccaaaccacccgcactcacgactctgtgctccataaccagtagttgaaagcaagaggaatatgctgccttatagtctttggaacatgtttcagtagaaaaaacacagacaaggtgttggagagactttgattctagtcacagttctgcttggtttccttagcttccttgttagtgagatgtggctactgaactaccaatcttctcttttaatagctgcactctgcaatgacgatttttaagccctctggtaagcataagatataacaaaggaaattgccccatatctaacaagtgctctggaactgtcctttccacagtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacaggtgccttgactctctggcttccagattgctctgttttccccttcacatggaggacttactcctgttgttttattttttcttctagtgaaatcctgtgatgacttcctgggccaactccctcatggccgtgtgctacttccacttaatctccagcttggggcaaaggtgtcctttgtttgcgatgaagggtgagtgtgacccagcgttgagaccaaggactcagtgtggagaatcactctcttgagatcaggggttaatccaattaaggagctgacctagtagataagaagtacccagagagattaatttatggaagggtagttttgaaataagggtagggactaagtggcaccactttcagaaggcaatgagaaaatggcacatacagctcaatgtcaggtacaaacctaaatacagtcactgatcttgagtacacagttggaacttgaaatgaatgggtacgtatttatttggaggcaaaagaacataattttataagaggtatgctagaaaataaatgatgaataagacaaaaattgtttgccccataagaagtaaggtagaggttgtcttaagaaacttaaaaccaatcaatagtggaatctgtaatagtgcatggataagtgtgttttaacccaataatatatcttcaggtcaggaatggccagtgtaattcttttaatgcaggatttttctcagccactttgccagccagtgacttctggacagcaatgcccctgcccaggccttgcttgggcccaggctcaccgcaggaaacaccccagatacttagcccactgggcggcgtctggctggtgctctgactgggaccctggggccaccatgactgcacactcagcccctggtgggaggggatgtgtgagtgagtgagtgtggggtccagctggccactccaagcacctgcacaggaatgggctctgagcagtgctggcggctggaccaggcatgtcgcactgaagggaacgtggtggtgcccaaacaggggtgcccatgaccccaaagcccagaggaggtgttacagcacactaatggctcttagcatttgataatgcctgcagcccaacagatgacagtgtgcttaacagctctgtcaatcctgtcgccccacatctcctgtcgcccagctctggcttgatccgctgctgcttcctttcgcgtggtacagctgccctcccacagcagagggcggagggccacagtgttacaggcttctttgtacctgcgtttggtgggtcctgagttgttgtcccgcatccaagaagaacaaggttatactgacaatagaagggtgaggagggtggagaagagttttattgagtgacaaaacagcttctcagcggagacgagacacgagggtggaccccagatgaagtcagggggtcattctctctctcagcgtggctggttctggggcttttatggacacagaatggggagcctgtgctgattggtttgtgactatgcaaaaaagactaaaacaaagacaccactcaaaggtgggcacaacagtgtaaaaaaccaattagggaagctcaggtatatgtaaactaaatgaacagtgaggatcaatcagaggaaagcacaccaaatgggaagagaggttctcaaaccagtccatggatttacctggaacttgtagctaggctttaaactgtcttcagcttgaaggtcgggtttcaccgggatctgccccatctgcctaggatttgtctgcctcctgcttctatcagtttcaagtggtattattagttgtttatgtgtatccattactcttggtggtgtgcactatgagtctggagggataactagattgggcaattaagcagttatttttaatgatttccaaagaatcttcggcatttacaaagtccaccacctaataatgatttccaatttcagaatgatttcagatttcagaaggcaagcaggattcaataagttgggcattttggggtgcaaagactcttcccccctcccttctttttttcttagagcacgtggttcagcatgcttctgtgagcctcctctggcctgttacagttgtagtagcaagaagaacagtgcccgttctctttctagatgttcctggctttgcttaccaaatcgagagctgttctgcctcatgacccactaatgagaataagtgggatgtcagagagccatcagtgaaagatgacacctgaaggttatggctcttgtgcccatggagaagtatggttctgtgttcatgccttctgtaggtgatgctgggctatgaagtttatatggcaattatgcacatcagctctaattgctttgccagtcacagggtaccatggttctttagaataaattggcctttgagtttctgtcagctactgaagaattcagatccctaatgaactaagacttttagctgggcctgaacctaagacctaaatgatagtcgaggaggaaatggtagtgaggaagctgagcatctattagcgaagaaatcaagggagagatgggaattgctcacacatttgctaccactttttttttctttaggttccgattaaaaggcaggtctgctagtcattgtgtcttggctggaatgaaagccctttggaatagcagtgttccagtgtgtgaacgtgagtagaaagaactatgtagtttggatagctctccttattttcgttttccagcatgtttttccgcatggcatcacctgttgtctagatctttacttaactaaattatggataaaaatacttctttgttggaagaatttcaagaagggtcttgtaggtcttctctgacatgtgtttttgttactaatctgcaaatcacttagtttaatgactgtttaattttgtggggaatgtgtggcaagaaactagatgacataaaggtgcagcacgttttagtcagtcatttatttttagttttcttatcaaggaggaatctttcttaaatttttatttttatttttattttctgagacactgtcacccaggacagagtggagtggtgcaatcacagctcactgcagcctcaacctcctgggctcaaatgaccctcgcacctcagcctcccagtagttgggactacaggtgcatgccaccacacctggctaatttttgtactttttgtagagatagaatctcgccatattgccccagctggtctcaaactcctgggctcaagctatcctcccaccttggcctccaaaagtgttaggattacaagtgcgagccaccatgcccagccaaatttttatgttcttttatcccctcgcatatcataaacaatttagtcagcttgttttttagcctgcagtatttaatgacatagggcttcccatgtgccaggactttccatgtgtagaaaaagcaatgaatagtgaatgaatagtgaagacacctccctactttcctgggatgtattttcttgttgggaagcagactatgaacaaggaaataaataagtaaacaaaattctaaaaattataacatataaaatggtagttaaatagggatgttatggagaaaataaaacagagttatatgataaattagtacgatggaaggagctgggatgatgaatcagtgtctgaaatgatgaggtgtcctaagtttccaaaccatccgcttaaataaaatatgccaaaattcagaaaaaattcagaaactcttagataaaagtacatgtttgacataccaagacattactgattgattctattctgtctactaaagcaaggcaagaattttttaaaccttgttttcctgattattagaaaatgtttattttaatttgtattgtgttaaaataacttatagaaatcaatttggataccttatggtgagtattatggtgaagaacattcaatacctgaggaaactcaagtattcaacaaactcaaccttacagagacacatagagctgaaaataaatatataaataaacttaggaaaacacaaacaggtaaaattcaagcatgagaagtcaatcattgtttgatgtactaggtcttttatatacacataattctgataaatttgggtatctcttcctaaattcatatcaaactagaagcatcaattgcttttagggaaggaactgttctaagcagactaaaaggaggaagaaatggtggctaataattggaagaaatcaaaaaaggctctttggcaccatttaatctgagtaaaaacagccttactggtgtctgatgacaccactggaaatttggtattggtcctgatggtaatggtcttgaatcaccaagaaacatttacattgctaaagatgatagctcatgtttattaaagttcatagatttccttgaaacttatggtctctgatgaccaaaactttgtctgtcttgaacctcattgtcaactcaggaatcttactatgcctgagttaaagtagacaaccaaatgggtgtttttaaaaaaaataaaaacaattactttccaaattcattgtgaacataggtacctgagtggtccaggaacactgtctttgggcttttgcaataaactgtaatttaggtctcacttcagttagttgcctctcaacaaaagccttacagatttaaattccgtctaccttagttatattctttctaaaagttatattctttttaagcgcacagtcacaggtcactattgtttcagtcatcttaagtgaaattctaatagaacttaaagctcttgttttctttctagaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctggttagtacctgcttccacatatcctaaatgggttcagaatatctaggtaagaacctccatatttctatagtgacagtcatttttgcttgtgaaaatggctttgctgtaactgtcagagacagaactacctcccaagtgaatgacaaacgggttatagataggcacgctgtctcaattgttggtattctgatggtccttcctatggggtgaagagtgtgggatggtaaggagagaagggggtggacagtgaagagaattgatgaggtccagatttagtagggaatgttttcaaagtactgaaaacaaatgctaaagaaaatactcttttattccacctctactactacgagttatctttatcctggagagatggatgtgctgtgcaaaaagtacacattgatgatgtaatttacttcagaactgataacgctataaaagtaatttgagaaactcagatgtagggatttatactttttatgttgtttccaagggtttgttcaagccactgactatgtttgtttgatccttcacctcaacattaacaaagggaactcaggaggccctggagaagcagagtttaaaattgtactcttagcctaatgggtgcagcaaaccaatatggcacatgtatacctatgtatcaaacctgcacattgtgcatatgtaccctagaacttaaagtatatatatatatatatatatatatgtgtgtgtgtgtgtgtgtgtgtgtgtgtgtatgtgtgtatatatatatgtgtatatatatgtgtgtgtgtatatatatatatatatatatatatatatatatatagagagagagagagagagagagagagagagagagagagagagagagagagattgtactcttagcctccatagctcattcctttgatatattagtctggctttaaacgacagtacctgacaactgtaggcacatgtgtggctgtgactgcccacaccagttccatcttccagtaaggacagaacagcactgaatcggtagcttgtcgatccctgtggtactcccccatctgatctagtttgaagttagagactgtagaggatagtgtttaaatgtcaagaggtctaggtttagagaacccgtctttcactgatcaaataggagggagtggcttatgacctggctggttgaggtcttcatgtacctctaatagccagagatattggatgtgttcatgtattcatatgtctatgtttaactgagtgtcttttcttgtgtttgtgtgggaacttgttcttagcctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaaggtgacttatttcttggtattccttattcttgctgggttgtatggaatgcatgaggcttgtaaggctgagagacattgaaatgagcttaatgaaagggataatatttttttcttctcggcaactgctttcttttcatttacataaaattatttcatcttattaactgtcctctttgcatggtcgatagcagtgcttctccatccagagcattaacaaaatcaccttgttaaaaagattctcaaactccattccatggcctctgattctgttttaaagtggggtcaaaagtctatttttaacaaactcatcagaatgctctgatgcaggaagaccacagaccacacttcaagaaataccactttgccttcttggtttgtatctaggaaaaaaatattgtaggcttaattttgagactattacaactgaaaagaagtctgtgcttgaagatgaaggatgtactgatggctgggcagaaaaagaaagtaaaacaaaggataagttaaacaaaataaagtagtctgggtgcggtggctcacacctgtaatcccagcactttgggaggctgaggcgggaagatcatgtcaagagatcgagaccatcctggccaacatggtgaaaccccgtttctactaaaaatacaaaaattagctgggtggtggtgcgcgcctatagtcccagctactcgtgaggctgaggcatgagaatcacttgaacccagaggcagaggttgcagtgagctgagatcacgccactgcactccagcctggcaacagagcaagactccgtctcaaaaaaaaaaaaaaaaaaagaaaagaaaagaaagtaaattaattagaaagatgtattaaattcaggctgggcacggtggctcaggcctgtaatcccagcactttgggaggccaaggtgggcagatcacctcaggtcaggagttcgagaccagcctggccaacatggtgaaaccccgtctctaccaaaaatacaaaaattaatcaggcatggtggtacatgcctgtcgtcccacctacccgggaggctgaagcaggagaattgcttgaacccaggaggtagaggttgctgtgagcccagatcgcgccactgcactcctgcctgggtgacacagtgagactcaaaaaaaaaaaaaaaaaagaaaaagaaaaagaaagaaagataaattttaaattcacaatcatgatttactaacttctttgttctatgtgcagaaattggccagaattatgcatttaataaagagcagagtgccagtatttgttgtgaagccagacagaattaacatggtactcctgttccctcacagcgtgaccccagtggctccagggctagatcaccgttagcctaattcctaatctttccacagctttccagttgcagagctgttaatcaacagtgaatgcacagtacattccatattctattactttacattaagaaatgggagtcaggaaatgttaaatcataaggtttttggaggaggaagattagtaacatgtttaaaaacatgcttcctcttagccaagggcaaaataggttttggctattttctcctattctcgcagttaaaacggacaatcaacaataaaatatcaatttctttctgatttgtctaatttcagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtaagtgcaagtgcaaggaatgtgggatcttcccggtcatggttattgctcattcattcatccatattggcatcaagtgtagtgtgatgtttatggcatatgctatgagctatagagtacaatatgagcatccacctattccaaaactcccatagtgagagtaaggccagacttcctcttctcatacttctcactgcagctctgcaccttttttgtctatatcactttgtggttgcatgagccacacagtaatgatttatttacagcctacgagccttacaagaaatgttttcagcatgagttagggagcaccttccaagctgcagagagcagccggcctgtctccctcactactggaggggacaggattttaagctagcacagctggatagagcagatttagaaattacgtatcattgagctctgtagaagagtagccctctgctggcaactggaaggtactgtaagatagaaaactacccacatcatggagcagatgagcaaagttaataatgaacagcctttcttaatccaagttagtgctacactttcccttctccccatctcttatgactcttctaatacatggttctacaccaagattgttcaagatccagttttacaattaatcctgtaaatatgctaatatgactcgcagataatatttctaaattatcagcttgacactcccttaatatcaaattatatttgcttttttggcaaaaatctcactggataacttactaaatgcttttagagtattctgaagatctggctgggactgacagaaaattcaggtcattggagaaccaaccgtatcaaatattagaacaaaatataaagcaataatacaaaagtcactttgcaccaggataagaagagacatacaaataagtggaacaaaattgatattaataaaataaaggggccaggtatggtggctcatgcctgtaatcccagcactttgggaggccgaggcggatggatcacctgaggtcaggagtttaagaccagcctggccaacatggtgaaaccccatctgtactaaaaaataaaaaaattagctggtcgtggtggcagatgcctgtaatcccagctactcaggaggctgaggcaggagagtcgcttgaacacgggaggtggaggttacagtgagccgagatcgctccattgcactctggtctcggtgacaagagcaaaacattttttaaaaattgtccattaaattaacaataaaaaggttgttaggtgaacacccaatacaaagcaaggatgtgatgaaactgatattgttgtgtgttgaaggtactattgtaaatttgcaaaaactcttatgaaaaacaattatgaaatgtatgtggaaaataatacaactattcctgccagttagccctcctagaaatttaatctaaggaaataatgtaaaatattaaaatattctatgcattttattaagggtttcatgagacagaaacctagaaacaagctaaatgcacaatagaagtcattgaatacactatgatgcatctactagattatgttagtttgcctttgttgtaacttatatttctagtatataattatgtgaaaacacacatataaggaaatgtaccagaacagaatgtatcaaaacattttttgggtatgaggattggggtgacttttttctttagttctgtattataaattttcttctgtaattgtattaataataatttttaaaagtcttctctgagtgcagaaggtaaaatgagagtatgtgaatgaaaccaatggctttttgcattagaaaaaatattagactgagtcctgaagaaaaatcaggatgacttgtcactggctgagaggtcctgttcaatcatgttgcatgccagagtgatgttttgtgacttttgtcttccttttaggtacacatgatgctctcatagttggtaagttttatgaaagttttgctgaggaattctggcatctataacagtaagtacctacctataatgaatgaaatgtaaaaagagagatcaaaatgtcttgaggtgtaaagagatcaaaatatcttcagttgtaagttcaactagaaagaaaataatgataagttaggccacaatatggtgaaactggcatcgtcatatgcatactaaataaccttcatcaaaggctctttactatctttgaaccattacaaatgaataatcattcatcagtgtcaaaaattctttatttgaatgtggtgggagaatgcaacttcttctttcagttgtaacctggagtatgcttccagatggtgatcctgctcatttgcacaaatagaaagccataagaccagtcttctgagcccatatctgtgatttgcctaaataagaatagttttgtaataaagtttgcttccaagggaatactgtggcatattactcttacatccctttttacgcatctggacactgagacacagagagttaacgtaacttgtccaagaccacagaatggggtagcctgggtctacttatctgtggagactgtgcactttaacaatcaataaatggacaaaatgacctaaatatgtaattcaacaagagagagaattccagtattttcacaatgaaatgcctgtgtgttaagtcttaggcaagagacatgggcagggccatggagagctggtggccagctgccccatcacggttctcacttacttttggaaaagctgacattggactaaacgttacaaaacggctcagctcacaccttaactttaataaccctgtgggagtgagactaatgctatagaaacccagagtaaagcagaatgtatagttacatctttaaaaaaaaaaaagcattggcaatctgtagtgggactggatactaagatagaatttaaaacctgtaagttatattttccatgcatttaattaccttgttttactgcctaggcactttatctggtacgatcttctttattttactcatcattttcctctcttggataattctaaagcacagaaaagggtaagtatagccatattatcccaagaaatgtaaactgtacttaccccctcttggaagtcaaaagaaagtaaaagacaaacaaacccattgctacataaacagatgtggtaattcttataaagaaagtccttgacacacagtatagacaaagaggtattcacactaaaggaagtatataggatactaagaacaattaaaaaataataataataacaaaaaaaaagaccatttggccaggtatggtgactcatgcctgtaatttcagcactttgggaggccaaggtgggcagatcactagaggccaggggttcgagaccaacttgggcaacatggtaaaaccctgtctctactaaacatacacaaaattagctgggcgaggtgggacacacaactgtaataccagctactcgggaggttgaagcatgagaattgcttgaacccaggaggcagaggttgtagtgagccaagactgtgccattgcacaccagcctgggtgacagagtgagactacatctcaaaacacacacacacacacacacacacacacacacacacacacacacacacacagcattttaagaaggaattgagttttacagaaagagaaagtaggcagaaggggtttttaaatagttgttcatgaggctgtttgatatcctagttttgctaagacattgcagacactgacctctaagcccagatcctatcatagcactagaagttagattgggtcacttatggcacacatatcatatggcacacataggctgccagtggggaagaattgaaactttccattgggtattttaatatataaacaaatattttgtaaacaccattaacttttttttttttttttttttttttttttttttaagaccgagtcttgctctgtcacccaggctggagtgcagtggcacgatcttggctcactgcaacctctgcctcccagattcaagcgattctcatgcctcagcctcctgagtagctgggactacagccatacgccactacaccaggctattttttgtatttttagtacagaaagggttttgccatcttggccaggctggtcttgaattcctgacctcaagtgatccacccgcctcagcctcccaaagtgctgggattacaggtgtgagccactgggcccagccatcattaattttttaaatttgaaagaaaaaaaacttgcaaagactaagatctgaataaagaaacgtctttgacagggaagagaacctacacagcttttgtactggttgattgaattataacaacctcaatgaggccagaatcaataatatcaatgttatatggttgatgagcaagttctatacccatagaaaaactgaatttgtaacttttaagtgaacggttttctatagcaaatattctaaacaagtacagtttcctacaacaagctttacagaaactgaagttttgatatttcacaaagatgccaatatactttttaaaaagtagtttgtcatagtagatcttgctgtaaagaacctagacaggaactcaatttcatggaaaaatactgaattggtagatatttaaatttaaatatccatccttcctaactaatgttctctatattttacggcttgacatatattctttgctcttttccattacaaaaagaaaaggtaagtagctgggcactttaccttaacaaagtacttgtgtcaatacatttttcctcttaaagtttctcattaagtaccatataattagtgagttaattttttaaaaaattactactacgtctgaattaaaggagttggggcttctaattttctgtatctatatcagtctctagttaaaaccacacaggggaaatgattatcccttcttcttggaagtattcaagatactttaatatcttgaagatatttgattatctccacccttctaactatgtcattcttcattacttatggtccattccttgttaatcaactagagggtcacactcccaagcctaactattgatttgtttcacctacataatttaagatcatttcctcatattaatcaccttcaggcataaacatgactcaataaccatttcataaaattatttctttggaaatgattgtcttgtaaagtctaagcaacctgagaccatataccatttcttcatgttttccatctcgtaaaacctgcctcctatttttttcatattctttaaagtgtaatgtccatggcacaaccattctctctctgaccagtggctaccagaaatgtggcagaaagaaagatcatgatcctcgttagacttaaaggtcagggatgtaaacctcccaaacatctatgtaacccacactaaaacctattctatatgtgtaatccaggaaagtttttaaacattttctaaacttttacttttgacctgtttcacttcttgggattgtaactgcctgatgtgttcttcctgcctgtcatacagacaaaaccagttccctgagataatggcatattgcagtaaagaaagagatgaattaatacaaggccagtcacgtggaagaactggagttatcactcaactcagtctccccaagaacacaggggctagggtttttatagatcatttggtaggaagggagctagggaatgggtactactgattggttggggatgggggtgtgggaaatgttcctcatgtgctgtgtccacctctggttgggggccacaggaccagttgagtcatgagtcacaagtccaggtagagtcagtcagttgccaaatgcaaaaacctgaaaaacatctcagaagaccaatcttatattctacatagtgatgttatctataggagcaattagggaagtcacaaatctctgagcagtaatggattataaaacctatgcctatattttagcagagttcaggtccctctcctaatcctaatctcttggcctttcattaggtttcaggtcctgagcaaggagagagctagttttaggaagagactgttattatccttgctccaaagttacattataaactaaattcctttcatggttagcttggcctacacccaggaatgagcaaagccggcccacctgtgaggctagaagcaagatgaagtcagccatgttagatttctttcactctcagaatctttgcaaaggtggtttcagcatagtgagtgcatttatctaacaaaacaccactgattttcatgttagaaataacacatagctaaaactgggaaaaagaagtaataaacttaaataatcagaaggcagaggtcccttctttcggaaggagttgggctgattaatcatgcagtcatacctccttgagtgggtgtggccaataagctaagtcattgtggctatgtgaggagggctgattattccttatctggagctcaagctttcctcacagaaagacaagggcataaagggcctcatggcaaagaagaaggaagccatgtgggaaacacagaatatgagtggagagtatcgtagtggtcaccaagtcagaagagccatttatcctggagctaaaaaagactgacagatatagaatagtgtagaacaagatggcctgctctatgggagagccacagtcacaccaggcctagagaggtgcaggctgacttctacctcaaacactggagacaattcagaagctgcataagcagtctgaagacttactaagaaactaaaatgaggctgggtgcgatggctcaggcctgtaatccctgcactttgggaggctgaggcgggtgggtcacctgaggtcaggagttggagatcagcctggccaagatggcaaaaccctgtctctactaaaaatacaaaaattagcctggtgtagtggcacatgcctgtagtcccagctactcaggaggctgaggcaggagaattgcttgaacccaggaggtggaggttgcagtgagttgagattgtgccactgcactccagcctgggcaacaaaggcaaaactccatctgaaaaacataaataaataaattaaataaaataaaacaagaaaagaaactaaagtgatagagaaatagaaggaatacacacacagaaatgatctcaccttctttaaaatgctcctcaaggaggtctactttaactatcctagtaaagatgacatgaccccacccccacattcctagtctctcttatcctgctttatttttttcatagccttattctcttttattataattaattaaataattacattccatgtttattctctctctccctccatgaagtcggggatttttgtcctatcttcaccaatggatacacaacaaatctaaactgtccctgggacaaagagagtctcaataaatatttatcaaatgaatgagtgagctacacaccactaacagtgttaccacaaggggaaatttctgccgtaattctctaccaagttgaacagtgcgtctttaacttgtcctaaacttactccaggtttcaaggctgctccttgttctaatataccaactgtctcagtctgttggtatatatacttgggcagttataacagaaactccatagactgggtggattcaataagcatttaagctgggtgcagtggtacctgcctatagtcccagctatctgggaggctgaggcaggagtactgcttgagccaatgagtttaaggccagcctgggcaatatggtaagaccatgtccctaaaaaacattatgtcatttctaaaaaccaagcatttttttctcatagttctagtgggtagagagtccaaggtcaaggcaactgcaaattcagtgtctggtggggatcgctttctagttaatagacttcaatcttttctccgtgttctcaaatcagagaaaaggagtaaaggagctctcctggtctcttttctaagggcactagtcccattcacaagggctctgctctcatgatctaattacttctcaaaggtctcacctttgagatcctatagtaattagatcctataaattttcaacatataaatttggaaagatacaaacattcagtccattgtaccaacactgcatttggtaagcacatatgcttaaacgatatcacacttgatttcatgtgccttctcaatcctcagctttccctgattaagaatacctaattactctgcccatttcctctgcaccctccaccttggcctttccactcactattactactatctcctgccttcttggtctctactattctcctcaccatccctgctccctggactatgatcccctgtgagcagggaccacctatatccacccaaagcaatttttatttaatgattttttaatctctacttgtacagcagtcaaaattaataataagagtagaaatggttaatgtatctacaaaaagagttaacatgtttatttataggtttatttaccatttattatcttctttggtcctcaaagcaactctgtgaggtaggtaggcccaatcatattgttatcccaaagcataaaacactctaggttcaaagaaattcagtggcttgtttaaagccagtaggaagttgttaggaattaggcctttagtccagattatttaactggaaatcttgaactctttgtgctagtattttgacaatgttagttgccatttctgaatctgactctatattactgaaattcagtatccagaactgtacatagtacaaacctaaagtattttccttttttctttcaatattctttttctccctatattttactgagtttgttttagctactttggtatattgaaccagtatctttctagagaaccgtatgcaatctctactttttttactctttattctgagtcattaggctataaaaaattaaggtatttctttaagggcatctttccatattgagatttcctggcgtttcacacagacttggcaagttcttcctgtgatttaatctcactgccttgttatttcactagttaaaaatatgcgcctgcacgttttgatatttcactgtgtatttacaacaataatttgtgataatgttaaataagataggtcataagataggtcatgcactcatcagtgaggaataatactggttagacttcttcattcagagcccattattgcctcttgttactgcctcgtacccactcccatttctacacaaaacagccttgtacacagtcaaaatttcaaagtttccattgttgtgatgtttagaatgataaaatacttaaggccatcctctgtgaagtctccctgaattttcctatgttcacattaaccaccagtaactaaccaaatagctcttcattcaacatatactcaccgagatcatattctccaaaaccccatgtaccactcatcacccaagaccaccttcagaacactactcatcttaccacttaaccaccactccttggaaggtcataccacctggctatataccactccactcttcctcatccatggatctcaagtgtgccttccctgtcctgtgaaaactctgccccctgaagcagtctgcctctttttctcaaatgatgctgtcattctaatttccataagatggtaaagaataactgagtgatgaggaaacagtggtacatgttgaagtgagttaactcttcaagcttccattctaaaatccctaataccaactcatacataaaatctccaggtactggtactgttttatcatttcattgataaaagatgaagtgtttattaacccccaaagaggcagtgtaccataccaagtgagggtgagggctttgcaaccgctaaggcctgtgttcacagtcactcactctctatgagaccctgagcaagatacttatcctcagtaaatttcattttccttgcctgtgaaatggagataataatagttcctaccttacttaacatagtgcctcatttatgatgcatgtcagaaaatgttagctattatttacacatgattgttattactgatattaaaaagtgagtaaatatttctttttactgttagttcttaaataccttcatgacagctactgctgctcccctaaccgtggatattgcttgtacagaaaacagaacacatatcttcactataggagaaaaaggaagcctcgtgtaacactgcagtgcaaagtcattcatgttgtgcagcttaagtgtcaaaatctcgatgtaaatcctatttactaatcaaaattatgtcagaaatagtgaaatgtgttaaggcatggacatctgcctataaacaatttagagtactctgacagaaaatataggatgattttagtattattttctaatctaagtttttgcttagtattaaaagatgagatttggttatgattttcctttcagacgtcttgcaaagatatcaggaacttaaggcaaataataccttaaatttcaaaatgcaaattactaatttctttcaaaacagatacttaaatgattaagacagtttttctatttttttctctgccaattagcaataatgcacatgaaaaccctaaagaagtggctatccatttacattctcaaggaggcagcagcgttcatccccgaactctgcaaacaaatgaagaaaatagcaggtacctatatacatactgaattcaaaatgttttcaacaactcaaatatcaaaaatggaaacaggacttgaatatgatattgcactaggtaggtcattgataccaaagaatttagaaagtacttcaggagttggaaacttcttttttttttattggattattattgtcatttccaatgttttggggtgatgactctataagttagtacagtcacagtcactactttttcaaagcattcctataatttcctgtatttatgctatgaaactttgagaagtagtatgcttttttcttgtggaacccaagaatttgctgcctgcttgtacctccaagtcttccagcttcccttaaatgcacagagtcactttaatgtcctctagagactttcactttacctccccagccaccaacccccttgatttctgacttccactgaattctctacttcatttggcctctttgactgctccttcttttggtcctcattcccttgggcttattaaatacctaacctttcattctacctattcaaagcaggcttactgcaagctgttgtgcagtacacattgctaaagatttggggtgaaaagggaaattataccattatcaaaagtggtatgtatcaatattagaaatcactgaactgaaaagtaactagtacaccagggacctgaaaactaccacctgtgagccaaatccagctggccacttgtttttgtgaataaagttttactggggcacagccacacccaatcgtttgtctactgtctctggctcccttttatactacaacagcagagctgagtagttgcaacagagaccccaaaagccaaaagtatttactatctggccctttagtggaagactttgctaacccctgaactatatcatactatgagaaatttctcactggctagttccccttttaacctgggctttccatcctcttcccaggcctctctctctcattggatactcctctcttttgttcaaatctttactgcattctcagggtatgcagtaaatacaggcattcagactctcgggcttcttgcaaattcaaaactccatttttctttaaaattcagagcaatttatttggctctggcttactttggctatgcccaagaatcctaaaatgtcctacccataggtgtttggaacattttcaggaataagatcaccatatgccctagaacagaattaggccagtcctgtagaaagcagaagcaaaagcaccacaatcattactgaatttcctttctttatgtcctacctctttctcatatacctgtgcattaatctaaatttggcatgttacacctacatacatcagaaatcctaaattcaacagaggacagtggaaggggccccaggaaaagtaaaggaagtggaaaaggtattttatagttaaccaaaacataagtagaagcaattcaaacttttctaaacaaaaaattacagattatgtcctattttctcctataatagaaatgaatttgcaatgccctgtttattatctgtcttcctagttgctttgcttctagcttatttgtcattactgtttatgaaaacaaatgaaatatgcattgcttttttaaaattcagaattgatattttactttttgaagctttaatgtttatctggcctgatccttctcaaatgggcatatgtatacactgggggatacatggctaatgctaatataccaaggggatataaaaatcataagatgaaaatggcatggtttcctagagaatatatttttctaatattactccaatagttcaaataaaaattgtattatttcaacatgaacacaaacacatttataagggaggaaaagacaaataaataatgcaggaagtttaagataaaataagacggctgggcgctgtggctcacgcctgtaatcccagcactttgggcggccgaggcgagtggatcatgagtcaggagatcgaggccattctggctaacacggtgaaaccccttctctactaaatacacacacacacacacaaaatttagccaggcgtggtggtgggcgcctgtagtcccagctactcgggaggctgaggcaggagaatggcgtgagcccgggaggcggagcttgcagtgagccgagatcgcgccactgtactccagcctgggtgacagagcaagactccgtctcaaaaaaaaaaaaaaaaaaaaaaaaaaaagataaaataagacagaaaatattgtgctttcagggatgctttagactatgtctccaaagttcttgcgtgaggcattcattttcctttactatcagagtgctatgggggaaaagtcaggcagaactgattcagggccagctgtgtggccactcatttacaaacagacgaaataacagcagactggaagaacaacaaccatttttacaagagttcattttaaaaatattccacaatgataaattatttgatttagcctcattcctgtcagattacctgcctaaaacacttttccgcctttctttctatctaaattccctgaacccagctccagctctgaattcaatcaaccaagatgctctcccaaacaactctagtccaaaatgatatctctctttgaaactcacatttcctgactacaccatttaaaaaataaactaatttattttaacagtaatatctcatcattgttaaaaacaagaaataggggaaaatataaaaaatataaaaattacctgcaataatctctatctagtagtattcttaagcttctttgcatattgttagacatttgcatatacaccttgagattatattgattgcacaatattgaatcctgctttttttaccaaatgacaaacatttctcccatcattataacagtacataacctatagtaattgacatttcctgtgttgttttttgcctgttaactctattgcattcatgtagttgcttatttattcttcaaacattcttagccacttacaatgtgccatacattgtgcttatgtgtgttttcttttccatgctaaattaacttctgatgaatagagacaattttttaaagatctccccaatctctgagtataatcaaatgagaaatgttcagtaatcaactgagcacgttaatcaattgagaaatttttcatgcacgtccctgtgaagagatcaccaaacaggctttgtgtgagcaacatggctgtttatttcacctgggtgcaggcgggctgagtctgaaaagagtcagcgaagggagataggggtggggccgttttataagatttgggcaggtaaaggaaaattacagtcaacggggctttgttctctggcgggcagaagtgggggtcgcaaggtgctcagtgggggagctttttgagccaggatgagccaggaaaaggactttcacaaggtaatgtcatcacttaaggcaaggaccggccatttacatttcttttgtggtggaatgtcatcagtaaaggcggggcagggcattttcacttcttttgtgattcttcagttacttcaggccatctgggtgtatacgtgcaagtcacaggggatgcgatggcttggcttgggttcagaggcctgacaaaattaatttatgaaaatttcatttatcctcaactttttggaaatactcttacatcaaagtacacctcaaattgtgtacactgactactgatcacttttcggtaggtataaagtccttaaaaattttgtttcaactttcccttttaagattagaattttgaccacagtgttccatgggaacaaagtgaatcatctgtggcaaaatatgctagtcaagaagtgagttagaatctgtgccaagcgttaagaccttgtgcacccaggttctggggcggagtaaagaggcaggctccaaagacatagctgtgtgttggacatgagagtatttggaggaatacaggtaacaggtgatgctgggaagtcctgtgaaatggaaggagaacgaagatgaggaatctggtggcagtaataaccggggaacagatgagctggaggcctcatcaggaggggtgtcccttggtggaaggacaccattcccggccttaaaaggagacgcttcagcacggctggggaagcacgtggataccttgtactaaatccactactgcagctcattcttaactgtaagtagaagaggaggacatgctttctgaagctgacccctccaagatgaccagttcctatttctgtcccctgctaccaccatggtgtagaacaacagaatcaaaaaaacattttttctgttatgggtgacctgtacgttttctagaatggaaggaggctgtttagtagctcaactctgagaacactttttctttggacaaaattaaaaaaggaaaaggtcaagttaatcattaatctctctgttttctactaatgtctccattttcgccatactttctatgtcctacatagcagccatcacagagggcaataaacacttctaatgaccgtgtaatttatatggaatgctgaaggggtgggttggccctccacacctgtggatgtttctcattaggtggaactagagacttggaaaagaaagagacacagagacaaagtatagagaaagaaaaaagggggcccaggggaccggtgttcagcatacggaggatccaccggcctctgagttcccttagtatttattgatcattaatgggtgtttctcggagagggggatgtggcagggtcataggataatagtggagagaagttcagcaggtaaacacgtgaacaaaggtctcggcatcataaacaaggtaaagaattaactgctgtgctttagatatgtatacacataaatatctcaatgccttaaagagcagtattgctgcctgcatgtcccacctccagccctaaggcggttttcccctaactcagtagatggaatatacaatcgggttttacaccgagacattccattgcccagggatgagcaggagacagatgccttcctcttgtctcaacagcaacgaggcgttccttcctcttttactaatcttcctcagcgcagaccctttacgggtgtcaggctgggggaaggtcaggtctttcccttcccatgaggccatatctcaggctatcacatggggaaaaaccttggacaatacctggatttcctagacagaggtccctgctgccttctgcagtgttttgtgtccctgggtacttgagattagggagtggtgatgactcttaacaagcatgctgccttcaagcatttgtttaacaaagcacatctgcacagcccttaatccatttaaccctgagttgacacagcacatgtttcaggaagcacagggttgggggtagggttacagatcaacagcatctcaaggcagaagaatttttcttagtacagaacaaaatggagtctcctatgtctacttctttctacacagacacagtaacaatctgatctttcttttccccacatttcccccttttcgacaaaaccgccatcatcatcatggctgtttctcgatggttgctgtctctttggagctgttgggtacacctgcagactaacaacagacaaaacaggcacacaaggattaatatgaaatttataatcgtagtacttccgatggtcttaacccaagtgacagggttaagatttgcgaggccatcagcaactcctgcgattgcctcagttcctggcaccaaatttaaatgggcttttgatgtttcaaaaatttgttcctttaatttggaaatgtctaaagtgagattatcttctgttccctgtagatggcatctgaccatgtcccagtgatgctcagactcattataaacttggggtgtaatacaaaaatctgagatattccagtcacactgtaactggaaacgatggtctaagttcataagcctgtctcccatccaaatgacagtttgtctaagatcattaatttggtttgccaatttttgatcaataccagattgtgaattccacaatcttgtagaatttttttgccaatcattaacaaagtttactgactgaacagaagagtgcaatgcaactcctgccatagcagccgtagctgtgactgcaattaatcccataatcactgtaattaaagtaaaaatgaatcttttggatctatttaaaatggcttttaatacttcagtcaaaatatggacggatggcaaggcctcccacggttggtccatggacatagaaatccacacggcttctcttgccctcaccagcagaatacactgttgccaattaaaagttgaataaatgcaagtaaacaatctgcaattttcacagcttatagtttgagagtctggtttaataactatatttcctacaactagcatataagggggctttacacaggtttggaaaggaactgttagactggaatttaggttgatagtataaaatagcttacgatctcgtttctaaagtttgatttctagaccaaattctaatgcagtatgaggccacagtaagcctccataattctggatgttcaggaccagaaacaggacttattatttttggtcttggggtagagattcctttttctccctattcccaagggtagaaagactgtaattttttagcttatgtttgtctaaactttctgttaagtcgctatcaacagctagactcacttgtgcactgggacacgactgagtttgtcctgtgcaattgtggtagaattgacctcgaggtgcccaatctataatagttccgaattcactgttttgtaatatcaccgcactattggccacacattcttcccaaactaaaacttctgtattttttgatcctttgggaatttccttggggcaaggtttccctttaggtctaaattttaatgatctttgataagaaaagtcttgtaaataatttacccgtggcctgagtgacatcccgcttaccatgtgataagtgaatctactgatgggactgacagtaggtacttctaccaaccaattttggactgcaggcattaaacatcctggtgctctccctaggcagataggaggataatgatacccaatggaaatatttatcatcatcccttcttcctcaggtttggcagggcaatgatcatctgtggggccaggtacccatacactatcattaacatatacttcaataggattatccatccatgtgactggtgtttccatctccgcggtggcgcttttctttgcatctccgatgggttcatcgtagatcttcaaatgtctagtgggtatccaaacaggaagctgattttctcctggtgaaacacaagcaaaacctctcccccacgtcaccaccttccctatttcccatgtcttatttttattatctttccaccaaatcagttttccttcatgtgggctgttctttttaccagtaaaatgttgttctgcagaagtagtagtctgatttctataaatgtttaaaaaatttaaagtatagagtgctagattaagttgcatctgaggagtggtacattccttactgtctcccccttctttttgcttaactgagttttgagtgttctattagttctttcaactatggcctgtctgtgggaattatagggaattcctgttgtatgtgaaactttccactgatgtaagaatttttggaaagctttactacagtatcctggtccattgtcagttttgatctttttctggaactcccattacagcaaaacaagataataaatgttttttaacatgggaagtactgtctcgattatctggccctaaacaatgtaaaatcacagtactttgatacacttctgaggctgtgcctacgctgacaagccctgtaacagcctttagtttaggccaatttttggccactgatttaaagcaatgatagagacatctgctccagtgtctactaacccttcaaactgttttccttgaataatggccttacacgcaggtctgttctctgagacccgacttgcccaatatgcagcctttcctgttggatcagtgcttccaaaccctcctgttctttttatctcactatttccaaccttaatataaggcaggagtaataattgcgcaatcctgtctcctggactggcactccaaggaattgaagagctaataaccaattgaatttcgccattatagtctgaatcaaccacatcagtacgaatttgaactcccttcagacttagacttgatctacctaagattagtcctacagtcccctcaggcagtgggccatatacccctgtggagattttttgtgggggctcccctggaagcagagagactgcctttatagtacataaatccacagctgcactgccgcttgtggcgggggacaattgttgtactgtggtaactggctcattccctgaggcacttgggacagtgggggttgttgtccctgaaaaccctgaggaacaaagggctgaattgggaatgccccagtttgttgcggggcctgaggctggcccctttgctcattttcccgacaatggttgcccatttctatcaaatttagaatgacattgactagcccagtgttttccttgtttacatcttggacataagtcaggtggctcttttttatttgagactgggcaattcttttttagatgaccaatttgatcacaattataacatttccctccaaatgttctaacttgtcctcctaaagcaactcctgttattgtggaataaagtttagaaaatatccaaagcttatcagcctgtaaattctgggtagttcagttgtctaccatgctgttaattaaatgaaaacatcctgttatttcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggattaccagtagatgggactacaggcacctgccaacacgcccggctaatttttttgtatttttagtagagacggggtttcaccatgttagccaggatggtctggatctcctgacctcgtgatccacctgcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatatttttaaaataagtgaccttgtgttctttaaccagtccacatctttagagaacaaaaatgtgttatgatattatgggccatgctaatgacctctagaaaacatcagaatatttctggatatttaataatagctttatatatgactaatgctcatttctatgtaattctgtttaatagttgctttaaaggtgaattttgccacatttactttgacagcagtataaggagtgagatagacatgaacctgaatttcaatttaaaatcatggaagagagggaaaaaaaaccagcttaagaaaaatcaactgataaactgcaagaaaaaaatgcaacttacatcacaaaagctaattgctttattatttagagagtacttaaaaattaaagaccaaacttctctccacccaacaaaaatgggcaaaggacatacagctaggtcaccaagaaagaagggcaaataggtggtgagtatatgtaaagatacttgataggacttttgcttagttgaatctttagcaaatctcttttatttcttgggattttgaagaagtaatttttaaaggaggactagaaactaagtgattgggaattggcctttttagaattaaaatttcccattacaagaaaaaaaaatcctgtgttcttttttttttccagaatggagtaggtcagtgagcaatgtgattaataaatatttcaatgtctgtgacttttgatttattttggagacagggtcttgctctgttacccaggctggagtgcagtggtgctatctaggcttactgcaacctcacctgtcactttttaattgcaagaaagctgaaaggtttttttctattatatcagttataatgataaatactgtatatactaactatgagtaaaatactatattgcctaacttgtattattaagcaattctgctaacctgtgaccttacattttcatctgaaaagcaggggctggacaccaattgccctatgaagctattgctagtcctaacattctttgttttgtttgcttttttggcacacttaagtgtgtactatgaagtttatgatgctttaatgaaattttctgtctctaccattgtaatgagaaaggaataaaatactttattttgcaaatctacttatggaatatagttctgtacctgattgttttcataatccctgtgttgatgtgtaatgccacagacatgctcttgatagtaacaggaaagaaaatcagacacagctaaacataaaggtcagttggctggcaggtgcttagcaggtgtaaatagaggcccattcatgctgctccacttgctcctgaaaagcataatgtaaatacagtatactaattaggaggcaaagaaccatctaacatggttcttttttttttttttttttttttttgagataaagtcttgctctgtcaccaggctggagtgcagtggcgcaatcttgactcactgcaacctccgcctcccaggttcaagcaattcccctgcctcagcctcctgagtagctgggactacaggtgtgcgccaccacgcccagctaattttttgtattttagtacagacggggtttcaccatgttggccaggatggtctagatctcctgacctcgtgatctgcccacctcggcctcccaaagtgctgggattacaggcatgagccaccgcgcccagccctaacatcaaattttaaaagagttggccacagtttaatgacatccctgcacaccagcctccacccatactgcccttcataagccccttaaaggagatcccatagttctaaaccgggtccacaaacacagatatcctcattctctccttttcttctctttggcagtttgacaaaatctttagggggaattggaggaaacattaatttcctaaatcaacttcattcaaagctttggcttcaagttctacccgttaaggcctcaggaagttcattgtcgacattgaactcagtcactaaaatgacctcaaggctaagggatagaccacagctccacttcacaagtaagcttgcaacacctgatttaggaaagtttgctgtgcagacagttgtagctcatccattttacagaccgatctcgatttgtttcctagggtctaaaattatttaaatcaaaatctctcagaaatttctggacatttaataaattcatgctggaggagaactggcagagatatgttaaatgcacttgaccacaagaaccatttatttcatccaatatttaccagctattcattgtacacttactacagattttggcactggagatattataagaaagctctaaccctgacttatggaacttatcccaaaaaataggaaacaaggctcagaaccattcaaatgaagcttcagttaactcaaataaaaattagttttataaatttaatgtgaaagtcttcgagtatattaagaatggcttgattaaccccagggatggaaattttactgattgaaagaaagtttcaataaaataccgatctttgaatctaatctgacacctgaaactaggaaatcaaacactagccatattttttcttctattctttataataatttttctcatgagaaaaaggtatctttcttccaagcctgaaaataaatggagaatttttaatatctattgatgtggagaaaaataaatagactatctgctttcacaaataagtgctggcattgagccacagaacatgtctgtcatattgctctttcacaccatacattaacaggaataataatttctcctcattgagtttcctatttactatccccttaattatacctcctttaattactgtcatagagtgtctgaattttataatccaagatactaagatgtttatttgatataccaccagactcaatgtcttgtattctatgccaaaaatttgaaaatgtttgggaagaggaaattccgtggtttggtgaacccagaaagtcttcagtacatctcagttatagaactgtattaaatacatttaaactctataattccataagacccattttaggtttatacactaagcatctaattcctcactatcctctcatacaaaccctgtgtaatacaagttctactcccataattctatgaacaaaacaacaattgatacatagatttgatttttaaaatacattttctttaccttattctaaatgtaacatagggtcaacatagaaaaagaaaactgaaaagcacaaggaaagtgaaatatctataatcttaaccattgttaattttgttgtgttccaaattagtgtatgtatatatatatatatatatatagcatttttgttttaataaaaggactgccaaaatgcacatgccaatttggactctgctttttccacttacaatgatatcatagtttctcacatttggtattcttttgcaatacttgctgcatagaattccatcacacaaaggtaactgcctccttattacttttgctagacacttagggtttacattttttacaaaaattataaatctttgatcacagctctgatgatttctctgggaactgagagcctaacacaagtcatttccactttaagacttttaacattctgaaaagttatgttacaaacagagtgctggtccccctgcaacatgttcactcacattggctgacgttttaattctttgccaatctgaggggaagagatgtcaactttttttgtttgctcttttaatgccagtcatgttccctttttttttcccccttttaccagtcatactggcttactcagaaccctacaaatcaatcctgctcattcttaattttccaacattgttcctgagattgtttcaccagaaaagttctcccccttatccacttcgcctaacaatttctacccatcccaatcctcctgcatttattgcttccaggaatttggcacttaggacacccttgtccttacattgttcatgcatgtatatttcgtcttcaataaaacatttagttgctcaagggcaagggtcccatagagtctcaatatgctaacggcctggtgttgcttaataatttagattctgacgggtcctctccagggaggggagcaaagggcaaattatcttaggggctgggagtgcagaagccaaacctttgagactgtgaaaagaagacggcgccgagacgattcagtagcaggcattcaagcaagaaaaactcaaatattgttcccaataatgcctgactaatgccaaataccaagtaagggcccaggcagtcctgacagcctgcagtgccccaggataaaactaaccctgaggggtgctagcccacgataaccccctgccagggctctggacacgccctgtctcctcgaaggccaacgggctgcccctgcgcgccgaggccccgccccgcggcccgccgattggccccagccgccccggcgctaagactcaatttcacactacgcgcccaggccacgcccacctgtcatgcggccctggaaactgtgagtttggggattgttgtgtccactaaccggactcagaagggacttccctgctcggctggctttcggtttctctgctcacctccggataaatcacggggtctcccgcgccgctcatggcgcctcccgtccgtctcgagcgtccctttccttcccggcgctttcctgggttgcttctggcggccctggtgttgctgctgtcctccttctccggtaggaccccggggtggattcgcgcgtccgcggcgaggctagagctctgctcagtcagtcgggcaggaggcgcggggcgaagctcactgcacgtcgtgcctgcttgggatagagagcgaggccagggttctccgaggggtgccgtgctcagatcccgggggtatgtggcgggggatgcgggaaccacgcagaagcttgtttggtggcatcgtgtgcgcggccgacatttacgcaggatctggctgcgttcccaaaagaagcgtgaatcgtgttttcgggattgagcccagtcagcaaggggagggcttactgggcgccccaggtgagggcttgctctggagtgcacaggtgcgtgggattgttgctagagcccgtgctgtgcccgtggtgagagtttgccctgtgttcccttggtgccttggtgagtagggtgttcattagggcttggacagtacccgcggtaagggttgcagtgcgtctgctgtgccccatgggctgggctggcctgggctgggctgggcgagcaggggcctggccaggtgttgctgggagcgtgctgtgcgcaagtggcctgtgtgcggagttcactgtgggcaagacagctcactgtttgctttgagtggagcgagcgcggactctgcggctagggagggcatgttgagtgagagcaggctctcagtgcctggggttagagaggtggtaagggcgcaccatgcttttagtgccttctgtgaacagtgtccgtgttgcctgagatcgtattggtcttgaattttaagtggctgcttttttggggggtgggtgggccatcgagtcatcttcctgttcccaaccaatatagacagtatctgattccattgcctagtggctttttgacattgttttccttcttttcattagtttgagtcatatttgagagatgtgaagcaacctaaaaaacactggtagccaaacctagtgagaaattagtatcctaacaaaggaaggcagataatgttaatcttgttttcccctacagctcataaactgaagcttaaggcctatcccactgttttgtatttcattgaatggaatcaatatttttaaaaatgcatgctaggccaggcccagttgctcacacctgtgatcccagcactttgggaggcccaagttgggtgattgcttaagcccaggagttcaagatcagcctggacaacatgtcaaaaccccatgtctacaaaaaataaaaaaattagatgggcatggtggtgtatgcccgtggtcccaactactccagaggctgaggtgggaggatcgcttgagcccaggaggagaagactgcagtgagctgtgatcatgccactgcactccagcctggatgacagtgtgagaccctgtctcaaaaaaaaaaaaaaaaaaaaaaaaagccaaaaaatacatgcttaaatacaggcttattgtgcaaaatgaacaaaataaaaggacaactgtttttaatattttgttatatttccttctgactttattgtgtttcatgtgtatctatgtccaaattatatttaggatcttattccatgtacagattgtacgttgcatttcttctcttaggaacattcattcaacaaatatgggtcttgtatgtctggtgctgttacactagtaggtaataacagacaattcctattttctttatcctttttttactatttgtttacacacacgtacatgcaggaagataagcagggactttttttgctcattgttaagtgcttaatgccgggaacacagtaggcaatcaacagatgtttgctaaaatgtattgggagtggcagacattaaccaaaacataatagtaacaaatatattaaccagggaagtgttctggaggaaaggagtataattttctgacagcatttaacaaatgactggggggagggaaggctttgcttctcatcaaacagacaaaactctgccactttggggcatctgtgctttctgttccctcagtcctggaacgttctccccatgacctgctgcataaatgggctgtttcttctgcaagctcagctggaatgttaccgcttcagagaccttcttggaaccccccaactcaggttgaacacatacaacccagttcaagtacctcttgtaatcacccttttaaagtgatcttttctgttctctgtctctccccatcagaatgcaggaatcttctgtcttcccccatttgtggttccaaaagccccatttgtttgcttctgtatgaaccctaactcagtatccatatagacatctgttaaatatcagaaaattaaatatactatttggctggggcttagagcctaggaaaaagtccctcctgcctccaagaggaaggttctttaaagagctatgctcaggatggtctttctgttgtacctaaaaagctagggcagcagcagctgagggccagaaaggatctgtctcccctgtttatgttgactctgcagggcttccagtacttcagtcttgcatctcactgatcattaaaacgttcattttgaaggagggtgatgggattagggagcagtggtgttaagaagaaaacgaaaggacttttttttctttttaaagattaatgtttagaataggcttagtactagaagtacatacagcctgggcatcataaggagagcccacctctacagaatattaaaaacaaaaaattagccaggtgtgatgttgcatgcctgtggtcccagctacttgggaggctgaagggcgtgaagggggaggatcactggagcccccatggtcaaggctgcagtgagccctaatcataccactgcactccagcttgggtgacagagtgagacccggtctcaaacacacacacacacacacacacacacacacagacacacacacacacacagaaaaaaaaaaaaaacctggaagttgaagaagataatgaaagcaatttgaaatagaggaacatagaattataaaatgaatagggtgcaacatggaagataacaaaactaaaaatgaagagaaggaaaaataaggttaagtttgaggttgatagggttaaatcaagacaggtatgaaacctagagaaagtaaaaatgagaactcacgatgctaggcagagagaatacatgaattaaaataaacattcaatttttggagcaactcactctcacaaagataaggttttgtaagcaggtggtgctgtgcatgggagacctgccctctcaaaggtagttgccaaatggttccagatagcagaaggaaacatgtgtcaaatttcaggccagtctcattcattcctccagaagaggagctgcttttttggacaaaacccccgatctcctgttgtgtgtggtctcttctgcctatttcaggtgttttccttattttcaatgaaagaagccaagaccagtaagttcttattgcttcttagtttcctcactcggcatactacaatgcaaaaagagcagtccatatctggtcacctgccaggataccagaagactgggagataggcagcacaagaaatggctaaatcttctttctccattgttctgtagaatgattattttcaatatgaaattgattacaatatattcttcacattgttttgtgtttgacagcagtggactttgagtaccaaatttttttcaaatagctactatgagggacatattgtgctgggtgttgtggccacatggatgaatggagtcggccttgttaactattaaactcaaaaacacgtgataattacctgagagatccatgcaggggagagtccaggggaaggtgactgatcactgcttcccagggggaggcagaaaatgcttcttggaggagatgatgggtggattaaagaagacaagagctgagcaggagttgtagctaccggccagggaggaagggtattcagagcagaggaagcaaggtgagcaaaggcaccaagatgtgacactgctggactgccaagctattcagtgtggcagagtagggtaaaggagacaacaaagaagggagaggaataaatcacagggtgagcagttctaaaaagcaacaggcttgtcaggaataaacaatcaccatcgtaaactcagactttggtattattccctgtccttttagggcagcttgagcccttttgtttgacttagcacaacgtgactccaaactagggttgttttaatttcccgagacacagtagtaggcaatttcttgaggacctaattgcagatagagtttgtcggtctcagcatgtgggagctccagatgaatggcagtaatgggaagcagtttggtagtggttcagcagtgtggcctgggaacctagttgactggcctgcctcctgggtctgccaacctaactggaatgtattcttgggttctgattgtgatgggatttaaaagtctctaagctatgttaggaagccttagacattatcctgaggtcattggagagccatcgaaaggtatctgtcttggaaaaaccttgattactctgtcatataaatactgctctggtaatgtgaaaaatgaattgaatgaaaggtggcaagataggtatggagacctatttagttatgtcgtggtaatccagataagaaatgatagtggcttgaatgaaaagtaaaggatacaactacatagaataaacgggcatttcagttgtggaaacataacttgtttggggggcgtgtgtgtgtatgtgtatgtgtgtgtagagtcaaaagtggctcttgggcctccctttgttgtttgagctagagtgacacattccaagtagagctgtgtggggaggcaattgaatatgtagttttggcaccccagctagagatctgggatggagagatacccagctaggaggcagctggttatcagtggtaatgaagtcacagaagtgtatatattctcccagggggacctgcagaatggaatcacaggaagtcctcctacagactcatcagggatattaccttggtatgagccagaggacaagctgaaaaccagagtggtttgctctcctaaaagccaaggagtgagaactcttcaggcagaagagagtgagggcagagtgatcagtagctctcacgttatcaagagggtaattcaaactattaaggaagagactgttaggaggagtttaacaaggaggaggccctttaatgactcagaaagtagttgaagtaattttcatagacctaaaaatgagtgggaagtgagaaataaaattgaaatatgtagatgtcagagtttatgttttgtggaagcaaaaaaggttttaaatagattggatagtgggagaaggagcaagatggtcaggtttcattgccatttcacttgtagtcaaataccatgaatttctggtaatactaatctgggcagggctgtgggtatgcgtgtacattagttaattttttgcaagcaggtgtgaatgtacagaagttgaacagttcagtggatgcagtgtagatttttttttttttttgagacagagtctcgctctgctgcccaggctggagtgcagtggtgcaatctcagctcactgcaacctctgccacctgggttcaagcaattcttctgcctcagcctcccgagtagctgggactacaggcgtgtgccactacacctggctaattttttgtatttttagtagaaatggggtttcaccatgttagccaggatggtctctatctcctgacctcgtgatccgcccgcctcggcctcccaaactgctgggattacagacgtgagccactgcacccggcccagtgtagataattcactttactaaaactcacctggaactttggggaaatttctgactgcacctatcttatgatataatggcacctactgttgaggtatagtattgtagcttaatattaattataatataaaatatctagaaaaaataagtcaagatactgtttttctgggggtaggcatgtttagtttgaaattttccataggaagaaagtcctctgaaaacgtattgccaataagtgcattgcaggacatgatatataaagaaaatattggacagtatatatatggagaattttagaatttagaatatgacatgaaatgaaggtgagatttcacttggttagaattttcttgaccagtctctcaacctgaggcaggaccatgaccagggagtaagaaaagaaatgctccttggagatcaaaatagatctatctactttggtccttccactatagaagaggcctttgcattctgttggccctttaggcttttacttgatgtctccatcatcttattttgcaagcccacagataatttgaggaagatgagttgccgcagtagaaatgatagggagaaaaaaaaaactacaaaaaacagaaataaaaaattctaaaaccacagcaatatagtagctttattataggacatgctggataaacaatccaacagctacctcaggg

SEQ ID NO: 1238 - DNA, 671835 bp, Homo sapiens
aattacatccttatggtatcattgaacttgtttccctgtcatctgtatttcctgtaactggtatttagatccaaaggtttaaacagattcaaatttgattttttttttggcaagaatacttcataggtggttgttatgtacttccatcagaaggcctataatgtctggttgcctcgctttttgtgatattagcagtcattgatgatcattgccagaatttattttaataaaggtttcaaaatggtgataaattctatccttcatttactggctgcaatacttttgtaaagagactccgcttcttaatatttagttaccctgaaatacattgcatacaaaaagcaggatgaatgcttgctcttccctccttttacttactggttatcaaaatatagctggtttcttaatgttttccataagtgactaatgagtttttaaaaaaatgttatttattatttatgattatttcaatagcttttggggtacaagtggtttttgttacatggatgaactatatagaggcgaattctgagatttcagtgcacctgtgtgagttagtgtacattgcacctagtgtgtagtttttatctctaggccccctcccagcctctgctgtctgaatctctgaagtccattatatcactctgtatgcctttggatactcatagcttagctcccgcttataagtgagatcatacagtttttggtttttccactcctgtgttacttcacttagaataacggcctccagctccatccaagttgctgcaaaagatattatttcattgattttaatggctgaatagtatttcatggtgtacgtacaccacattttctttatccactcattagctgatggacagttagggtggttccacatctttgcagttgtgaactgtgctgctctaaacatacatgcgcaagtgtctttttcatttaatgacttattttcctttggatagatacccagtagtgagactgctggatcaaatggcagatctactttaagctctttaaagaatctccatactgctttccgtagaggttgtactaatttacattccctccagcagtgtctaagtgttctcgtttccccacatccatgtcaacatctattgttttttcacttatccataatggccattctcgcaggaataaggtggtatttcattgtgttttttttttttctttttttcttttttgaggcagagtcttgctctgtcacctacactggagtgcagtggcaccatctcagctcactgcaacctctgcctcctgggttcaatcgattctcttgcctcagcctcccgagtggttgggattacaggtgcctgccatcatgcctggctaatttttgtatattttggtagagacggggtttcaccatgttggtcaggctggtctcgaactcctgacctcaggtgtccacctgcctcggcctcccaaagtgctgggattacaggtgtgagccaccgtgcccggcctcattgtggttttaatttgcatttccctgacgaatagtgatgttgagtattttttcatatgtttgctggccatccatatattttcttttgagaaatgtctattcatgccctttgcccacttttaaataggattatttgttttaaaaatattattacgaactcatagattcaaacacagttactatttttcatccattgccttattattattattattttatttttctagatttaggggtacaagtgcagtcatgttacatggatatagtgtgtggtgatagagtctgggcttttagtgtattcattgttcaaatagtgtatgtcgtcaaattctcctctgtgagttggaccagcagtgacagtgccagtttctcccacagttttgtcaacagtgtgttgcctagcttttggatttttgctgatttaataggtaaggaataatggagtgaaactgagtaccttttcatatatttcaaggtttttgcatgtcttttctttcacagtctttgaatgtttgcttatggtacttttagacttatttttctcaatttttaagagttctctatgtataagggatatttgcatgaatgttccatgtatgcttcaaaagaaagcatattctctaatattgggttgcagagtttgacagatattcatattcataaaaacttccttatgattattttggttaggtcttctacagccttacttttgtttccttgatttgttatgaactgagagtggtgagttaaaactgctgttattggcatgctccaatttgtctttgcacctcctggtttctgctttatgacacatctgctttcttattgggtgcatagttatcgatatctgttatatcttcattgtgaataatctcctttagtgctgtaaagtgtccttccttgtcctctttcatgcctttggccctgaattctaacttatctggtgtgaggatggtgattcctgttttcttgtttgcgtatgcctgttattcctttgctttgctttgctttagatttcaatacatggtatttaagccattttgaatcactttgtttaggtatgcctcttgtgatagcacagagtcaagttttattttgtgagataatctgaacatctttataattaaacctaattatatttaataatatagtggctacgtttgttttcaggtctgtcatattattttgtattgtatttacttggtgcatttgtcatatttactggttctttcacagtgtgtttttttggagtacttaaaaatatatgtattagtatttggcaaaatttatattttcttctagtaattacttttatattaatatatttataaatgtccttagtcctcttttttctacttaggttctaactgttttattaactggttctcaaccagtgcatctgttgatcaatgactttcaacagaggtggggggagtgtatccattttattccccagaagacactaggcaatgtctggaagtatttttggttgtcacaactgggagaggtgtgcatctattgggcagaggccagggatgccgctaaacatcctataacacacaggacagccaggccctacaacaaaaaaatcatctggcccaaaatgtccatactgccaagtttgggaaacctttagatggtctttgactcccacctgttatctgtgtggcaacgagtggggtcactttactttcccctttctctttctcttcccattaaaaaatcatgttatctccactttgtcagaacctaggacatttacatactattcttcggtctttattttcatcttcattgtagatttcaatatgcagttttcaattcttaacatcagtcctgttgttgaaattccttaactatcatttggttggttaaaacttgtcctcccagtagattcttcaggaagggctcctgaggaaaatattcctgaattcttgaatattcattactgtgttctcattgtcttgatgcataaaaatcactgcatataaaattcttggtttgtactttctttccttcagttttgctttgtgtgtggctgttaagaaatctgatagcaacctaatttaatctggaggctcagagaatgttttatttttctttaaaatcttacagtttgactggggtttgtcttggagctgagcattgcaggataattttcccaggaacctggtggacctttcaatatatatgttaagtttttcttttagttctaaatagttttcctagagtataattttaaatattaattctgtctaatttatttaggttttcttctttagggactcctattgtacataaattggcttgctttgcctgtcttttatctttctttctttctttctttctttttctttcttttttttctttctcttctttctttcctctttttctctttccttccttccttctttctttccttctttctttatttttctttttctttttttttgagctgggggtctcgcttttttgcccaggctggagtgcagtggcacaatctcagctcagtgcaacctccacctctcgagttcaagcgattctcctgcctcactctcccagtagctgggactacaggcacgtgccaccatgcttggctaatttttgtattttttggtagaactggggttttgccattttggccaggctggtcttgaactcctggcctcaagtgatccacccgcctgccttggcctcccaaagtgcccttttatcactttcagtctcatattttttagctctttacataacttctgttttcttagatatttaagttttcttcctgtatgtgctttattatactttctttctgtatgttacccattgaacactttgcactttgctcttcatttctgagatatgcttgttcttttattgtaagctgtcatttatttcttcctgttttatgtctatttgtatcctgagttttcaagcttctggtttgtattacatgttaatatttacaattgcttgattatatttaattaatgttgggatgctttaaaaaaagttttcctttcctttattttttaggggagtattttaattagttacaatgttttcttttctttgctttttttctcttttccactcttagatatatacccaagttacaatgtctttactactcattttctgttttattctttttttttttttttttttttttttattgatcattcttgggtgtttctcgcagaggtggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttggagtaaggtcatagatcaacaggatcccaaggcagaagaatttttcttagtacagaacaaaatgaaaagtctcccatgtctacttctttctacacagacacagcaaccatctgatttctcaatcttttccccacctttcccccttttctattccacaaaaccgccattgtcatcatggcccgttctcaatgagctgttgggtacacctcccagacggggtggtggccgggcagaggggctcctcacttcccagaaggggcggccgggcagaggtgccccccacctcccggacggggcggctggccgggcaggggctgacccccccccccccacctccctccgggacggggcggctggctgggcgggggctgaccctcacctccctcccagacggggtggctgccgggcggagacattcctcacttcccagatggggtggctgccgggcggaggggctcctcacttctcagacggggcagctgctgggcagaggggctcctcacttctcagacggggcggccaggtggagatgctcctcacctcctagacggggtcgcggccgggcagaggcactcctcacatcccagacagggcggcggggcagaggcactccccacatctcagacgatgggcggccaggcagagacgctcctcacttcctagatgggatggcgccgggaagaggcgctcctcacttcccagactgggcagccaggcagaggggctcctcacatcccagacgatggacggccaggcagagacgctcctcacttcccagacggggtggcagccgggcagaggctgcaatctcggcactttgggaggccaagacaggctgctgggaggtggaggttgtagcgagccgagatcacgccactgcactccagcctgggcaccattgagcactgagtgaacgagactctgtctgcaatcccggcacctcgggaggccgaggctggcggatcactcgcggttaggagctggagaccagcccggccaacacagcgaaaccccgtctccaccaaaaaaatacgaaaaccagtcaggcgtggcggtgcgcgcctgcaatcgcaggcactcggcaggctgaggcaggggaatcaggcagggaggttgcagtgagctgagatggcagcagtacagtccagcttcggctgggcatcagagggagaccgtggaaagagagggagagggagaccgtggggagagggagagggagaccgtggggagagggagagggagagagagagggagagggagagggagagggagagagagagggagagggagagggagagggagagggagagctgttttattcttatagaagctttgaagatatgtccatgaaccctttttgtccgtgagaaaagaaatgtgtaggattttcctagaccagcaataacaggtgcttctgctggagtgagggaatggagtggtgttagtgtttatttgatttcttagttcagggacactctgttctcttggtataggtagatcttgtggggtgcagcttgtctcacaggcattgtagtttgggcttgccccctctatctatgccctacggcttatgaaaacttgtcctggcctgatgtttggaagtctttccccactctatgtggtgtccagcaatctgctcttttcttcctttcttttttctcctttatttttagtagggacagagttttgccatgttggccaggatggtctcgaactcctggcctcaagtgatccaccagccttggcctcccaaagtgctgggattacaggcatgagccactgtgcccagcccatctgctattttcttataaagtgtttgcatatttgcatgctggtatgaacttgtcttctgaacttagacttaatatttgctcccttgctctcttgattcccaatccaaccggagcttgtgttggacaacagtccaattcctgaccctgaatccctgccaagctacctgaggttccagtgggaggactacacccaccctgctgattccctgtgtccaggagagaaatgccaggcagcgtgtccaagatggaatgcctttattaaaactgggggccaggcgcggtggctcacgcctgtaatcccagcactttgggaggctgaggcgggtggatcacctgaggttaggagttcgagaccagcctggccaacatgctgaaaccccgtttctacaaaaaaaaaaaaatacaaaaattagccaggcatggtggcgcgtgcctgtaatcccacctactccggtggctgaggcaggaaaatcacttgaacccgggaggtggaggttgcagtgggccgagattgtgccactgcactctagcctgggcgacagagtgagactgtgtctcaaaaaaaacaaaaacaaaaaactgggaatgttggtctaaatcaggttattgaggtgacaaggggggcagctggagccgaggtacagtgcaaaagtgaagggtagtgggagtcagaaaactgaaggtagtctggatgaattttccacctaaaatgatgactgctaacaaatgcatagtacatttaagaaaggataggctcctactagctcttgccagttctttcctcttcttcctcaccactcctctcatgactgtcttgcctggatgaccctccttgatttggcttttctctgctatggagtttctactgcctaagcccacctgcccttagaccgcggtcctcagatcctgagctcctcagtccaagccaaactccagccctgaggggagcaacttctttgtccccaggttcttggtctgagctgatgtggcctccactataaattaaaaaaaattgtattgtggtaaaatatatataacataaaattgatcatcttaaccattgttaagtggcatcaagtacattaagtatattcacgtaattgtgcaatctccagaacttttctttctcctttttcacaatacaaacatttaatgaaaattggttagtgagtgtgtataatccacagggggctaaatgttaacctgggactgtagcagaaatttaaaatagaatagatgctggagtaaatgttatatattgtcatcatctgattcatcttcttccttcaaagattccttggcatgtttctcttcttcttcccttatatcttttggaataatttcatgtcttcttcctttagttaattcaccaaccctgctgagttctaatttaaaaggtttattcttaacttcatcatatactatgtaaatatttttgcaacttcttaacaataacatggcaggtcatttctttcacctgaagcttttctattttctatctttgcagcgtgcctggctttgccaagggtacagccccaataaccatacgaaacatcttgcagaattgtgccctgttgttcacgctgtaagaccctactgtaaaactgcagccaaaaggtctaacagcactgcagagtgtatatgcatggcaactgtgtctgcaagatgtttttgtggaatggtatagccaaagctagatctaaagttggaagcgtcttctcttgttatatctgccaaagaaggggcatctgtcaacaaacctgctaccaccattccaacatgccaatcaatattaaaaagtcttttgttggagccttcttcataaagtttaggaagactcccttttctaccccaaagccaccaccatctttacatctgagtccagtggctgtactattttccacagccttcacagcatattcaactcaaaaaactcttccatcaggagagaatgtagagactgacaagtcatacctggtgtcaattgagctctttgttttaaaaccagtagaacgcgtagggcttccaggcctccagaaacttttcatcttataaaactgaaactttatactaattaaacagtaactccccatcctttcctccccctagtccctggcaaccaccattctactttctgtatgaatttgatgactcaaggtagcttttataaatagaatcacatagtatctggttgttttttttttttttttttttttttgtgactggcttatttcacttagcataacatcctcaaggttcatccatgttgcagtatgggtcagagtttccttcttttttaaggctgaataatattccattgtacatatgtaccacattttgtttatccattcatctgttgatggacatttgggttccttctactttttggcatttgttaataaatgccgctattaacatatctttttgtgaccctgctttcaactcttttgggtatatattcagaagtagaactgctagacaatatggtaattctatttttgatgttttgagaaatcgccatactgttttccatagtgactgcacctttttacattcccaccaatggggcaccagggttccaatttctccacatcctcaccaacacttattgttttttgatagtagccattctaatgggtgtgaggtggcatctcattgtggctttgattatttccctaatgattagtaacgttgagcattttttcgtgtgcttgttggccatttgtatattttctttggagaaatgactgttcaagtctttcataagagttctttatagagtctcaatattaaccccttatcagatatatgatgtgcaaatattttctcccattctatagcttgccttttcactctgttgattgtatcttttgatatacagaagttgtgaattttgatgtagtccagtttatctgttttttcttttgttgcctatacgtttgatgtcatatgcaggagatcactgccaaatctaatgtcatgaagttttccacgtacgttttcttgtaagcattttataattttagggcttatgtttaggtctttgatccattttgagttaactttttttatgtggggtatgcactatcatttttgctcagagtttccaacatgtagcagtgataacacaatgcagttaagaaatggactcccatatttctacccttggattttaggcgaaaatatgtccttctttccctttcccaacaaacacttgcccctagtcatgaaagaggccataaaaatgtaagaaaaccaatgcaaaaatttatattttatttgaattcaaaaaatttaaaattgctttcaaattcaggaaagtaccataatgcaggaccccagggggaagcctcatatacagagacagataaattaaatgtatatactgcagacaagccaagaaggtgtgtagattacatatttacagcacttgatgttttctgaaaaccatatttatacattttattacatttacaaaaaaggcttccactaccgtttacctacaataatgaaaaaaaaatttacacctttttttttttcttttttggtactgtacaaactttgtataataaaaatatatctctgtacaaaagattttttttgtctttgttttacttttttttttttcctcatgggatggtgatgggtatatggcgtagatggtgggtgaagggcctcatctgccctgttcccttccaagcctctggaggtggagagaaatgtcaggggtgcggagggtgatgcccagcagagtgctgggtgccccaccagcaggtgctcctcgagcatctcatggaactttacaaggagacgcaggggaggggtggggggcgggaataggcatccgctgggtggtctgagaggggcataagaagggggaagggagcagtcgaaggagaggagtgtaagggggaagggagcataagaaattgggaggggagcttcctgcacttgtttccagccaaggaaagagatgagagtgtgagtgtgtctggattggccctctccctccaggcccaggggggtgccgtgtcccagaggtggtgtggccaggggtaggctcctgcctctgtcagcctccattgtgtctgctggaaatggacgcctctcactttcctctggccactcttaacatcagtcagatcttctaattgttccaatctagaatttgcttaagaaccaggtgtcgctgtccctccgctcctgcacatttctatttgctatttcaatatgtgacatgaatctctgaggccagcatgtcacacgtatacaggggcttaagcttgtgggggccttcccgaggacagagaaagtggccctaaatgctatactttgattcctaaactcatgaacttcccaacaattctcatggaattcatgaacgacccaagcatgatatagctgtcaaaatcaatcaaacccactcgcaaggagctggagaggtgtgactttcagccactctgttgttttgattcaggacctgccaggtcttttgctggctatggtcagcggctgctgggagccaaggagccagcaccaaccgtgggaggcctggggagttgaatccttgccccgaagctgcctacgcggagacagcagaacccagataggacacacaggtgtcttgcctggctttccagacctggccacagtgctactgtagagattcatcggctcctcccttcttagctgccccttctagaacagggtttctggcagctggtgtagtggactttggggcagactgatctgggtttgcattctgactccacacttcctaactctgtctttacctttgcaggcttctgttttctcatctgtcaaaggggaataacaaatcctacattttggtgttattgtgcagactagaaatactacaggtaaagtgtcaggcacagagaataaccccagtacatgatagccattgttttttgggtactggggcaggcttgctcccctgttctctcaaggaccctgctgctgcccccagacttggcatcctgtctgggccacagacttgtcttctcttctctttgtcagttgacagccagacttgaccttgggctcctggccagactcctgccctatcctccccggctctcccttctttcccagtgcttcccaggacccaaatgactttttaatccactgggtttagaactcaataaaacagtgtttgaaaaaaataaagaaactgattttcaatctatttccaaagacttttttcctgcccttggggtaatccttgctgccgctgtgcagatgggccgttcatcagcagacagctggtttctgcacgctgaccgggtttctgcactctgaccgcatgatgggatgtgtcctactgttacagtcaccgagtcaccatgtcctcacacatgggatgggcggggggcatattgttttgaaagctgaccgtacctccccctcttcatctcttctctgtgtggggaacagggcatgaagcatccttcatgcgcacttctagttttgaagcctttatggtctcttccataggacgtgaatgaaggagaggtgtgtgtgtttgtgtgtgatcaggcccatacacacacacacacacacagatccacaagttgctttgctattttaaatccataaactttcttcctctgtctgcagcccctcttccttttctgccttttcaggacacggcaggagtcctctccagggtaactggcatagatggcggcagggcgagggcctgagtcccagcagtagcagacacaggcaaggagacgaacgaagatgggcactgggcactgtgctcaggggagcctacttcctgccccctggggaactgggaacaaacagatcacacctgagtttgcaaagaaaaaagaggcagtgggaggggaggggccgggagcagaggaggaaaagcaaagcggcaaagaaaagaaggcacaagcgggaaagagatgagtcacctcaatcttcactttgatttttaatcttcccaggttggggatgggggtaggtagggaatacgtgcagcagaacatgtatttttctgtctttttcccttgcagggccaacttcgccattagacctggaggcccagtgcttgggggccaccatacttttaggaacccaggaaaacattctaattttagtttctttcaaaatcagatgaaaaaaaaaaaatgactaggataataatggctctgtaataaagaatccaggctggattatattcatttttgtagtgacacagttgtgaaatctcatttttgatacttttttttaatggaggaagggttggcaaacatcatcacacagccctgttcccccgccctgttactcactgaccgcacaggcctcgttgcttccttagtagggtgtttattttaatttcagcttttctccttggcattatttaaaaaaaaattaccatctagtcactcatttgcaatgtgtgtgtgtctgttcagggtggctcttgctttctttatgctccagctgtgggcagaagtggtcagaggggccctgctggagacctgtgggctgggcagtgggttcagagcctgctggcaaggggccaatgctgagggctggccagatgtggagccaccaaccccagccgacccggaggtgacagcatggcgcacaccagcacctggaacccagcagaacccaggtgtggagcaagagtgactgtgtggaggtcagcggcattcttgtttctttcttacactgttcaataattcatgcagtgaatcagattcatcactgatcatctccaagccccgatttacatcatcagaggggatttttctttttctcttttgccttctattgataagagttctgagaaggaaaaaataaagattgggcatacagatgaaacttgaggagtaattttggcatgctaaaacaatcccactggaataagggggaacccttatttaaatgtttgttttggagagacgtaaaaagatggggaaaagctctttccataaattgtttgtattcaggagctgcatctgctgagtccctgactcactcaccatctgggactcaggctgaaactgtgaaatcctccaggagttgtgaggcagaaagggagtaaagcacgtcaggggctgggcagtgataatgacatttgctgctcttgtaaccccctccgcaggaactgtccccaccatctctgttggtggcctttgcaggcaccctcataaaagcctgtttcctcgctgcactgccatttgtgtgtggctgggagaatctgccacgtgagcggccatgcacaggagcgtggggagggagcgcaacactagccctgggtttggctggtggcccacttggcggattttccaccgccctcactgggaatccctacctggctggctctgtgactcttctccccagagtccttcagcacaggacctgagagggggcacctgcctatccccagaaagcgggatgtgtgggagaagacagttctcagaggggtgcagcttggacatcgtgttggggcaactcctgaagggtcataggtcccagaggtgagggtgtcatcgaaggaggacacagtgaggaagaggcagtgccttttagattcatcagttccttcccagtgggcctgtcagatgcatgcctgtgtgcatgtatgcgtatgtgtgtgtgtgtgtgtgcatgaccgtgtacacgtgtgggtgtgtctgccccctgtctatatttccgggagctcctcccctctgttgtgctcaatgtggggaattttgtaagtaaacctgcctaggctatggtgctcagttgatgggtcaaacaccaatctggatattgctgtgaaggtatctttttagataaaattaactttgaaatcagtagactttgagtctccataatgtgtgtgggcctcgttcaatcagctgaaggccttaagaaaaagactgaggtgctccaaagaggaaggaattccgtctctgactgcttttggactcaagatgacagcatcaactcctgctggaatttctagcctgctggcctgccctttagatttccaccttgccagccaattccttagatgaatctctctctctaaatatatatttatttatatttctatctctatataacatttacatatagctctacggagatgcgtatctatatatagatggataggtatggatatatcttgatatggggtatatgtattgcgtttatagtgtatgaatgtatatatatacacaatatacctatatacacagatatatgtgcatctctgtatagctctacagatctccagggcttgacttcgacccagaggatgtatatatccagttggttctgtttctctagagagaaacagactagtacatgccgatgttctgccaagcccaggggtgaggagcagtttctggagccagtcagcctgggattggatttcgaccccaccccttctgagctgtgtgaccttgctcaagttagtttctatgcagctcagttttctcatctgtaatggggctcccacaagcttctacctcacagggcgtgcagggattcaatatattagatccacaaagggcctggttcagtgcctgttacacaatgatgctcaatgcacagctctcctcttactgggtgtgtctatgtggtgtgtgcgactccgttgggtggagcccctggcacgcataggtccctgtctgtgcttgtcatggcctgtcttcctcccacacccctgctcaccggctgctggaggcggggctctcggtggcggtggtggcggccaggccgggtggctatactgctgtgcacactgtgctgactgtgaactccgcctcgctggccatgatgtctgtgggctggatgttgcggtcgtacattgggttctcaaatgtggcccgaacattggtgttctcgtggccagcatagccattgaaaggaactttgggtcttctcctggcgataaaagaggaagtgcccacggcatgaaaagagcgacacagagaggcttaggggtctggtgcggggggccctggagggagagagggaggcctgcctgatgcccgccctgcctccttcctgcacggtacctgtgcttgtagagatagagcacgaagcccgcaataatgagggcgatgaaaggcaccaggatcgcggctgccactgagctgctgttggaagcaaagtggcggccaatggactcggggtctgactccagcagcctgaggtctgtaaagtcccaaagcagaaaagtcaagtcacgagacacagtctgaggctccgttggctaccctccccgactatacactcttgggaagcagggctgccactcagggtgctcctcactcctgctcagcacgggaggcaggtgtgcccagggctgcccgcctgcctccacgtgcacactcagtccttgggggcagggtcctgcatgcatctaccttgtgctgctcagatggcacccagaggaccatccgcagaggagcctgaaaccatggctcaacagaaactcttacaagggtgcagccctttagaagtctctaaagttcttttggctgtagcagccttttatcagatgaaaccttacaggcacaacaaaatataagacagatgaaggtgaaactgttctggttgaagctgaagcatctccttctgaaaggctgcctctcctccttcctcaccctcccctgcagactgggaaggctcagaagaacacaagtagaaactgtggccccagtaggcaccctgctaactgaggggctggggctctgagaggggacaggatgtctgctgtggagccagaacaaaaactgtgattttctaaggcctttgcagcgtgcctggccatcttgcagtaggtgaagggtgctgtgtggaagacagtggtctcagtccatgcagctcatgagggcagagctgggacaactccgggggaggagcagtgtgggtgggaaagggtgggagcagaccgtggctcagtccagagaagctttcaggagcttggagccagaggacatggagtggactgccttggcaggcaagggccccggcgatgggaggtgtcagtgcctggggtacagagaggctgtcacgcacctgcggctgcctcctgtttccccctcccctgcttctgagaaaccagacccctccccccaccagagtctgaggctgggcacccagaggctctgggccaggacaaggctccaaggtgtggatgtttgacatggatgacaggaagcacgctaggtaaagaggccagggaaggaccagggagggaagtggccttaatgctcagttttcttatctgtaaaatgggcacaaaaccagtcttctagggctgggctagggcagaaacgacatcacagtcaaggcaccctgagagctctaagacactccacagtgtcgttgtttgttgaggcaggggtgacacccagggctggctggagggtgtggctgggggctgtatctaagagccaatgtccctggagttgggggctctcctctccaggtctgaacaggaaactttgtcaaaggttgagtgggttatgcacatgtgtttgcttttggagagatattccatggcttttgtcagaatctcaagaggcatccctgatcccaaagaggccaaagcacccccgcctcagactgttcaacttccccagtcctctacctgaccacggcacacacggtttctctcccacccacccgggcccacacttccgggggacaagcactagttacccagtctttgaaagccgaactgcccaaagccttggcccttgacagagccttggtagatgaaggtggctccggaggactctgacgagacctgtgatggtggggagcacagagagcaggtgggaggctgctggaaggatctagaactcctctctcatcatacacgctgcccagcaggtcacccactgacctgctgctctgacacacagggtttgttctctgcccacacctaggcaagggtgggtgtgaccggggagcccggggtggggcaggggcaccagctacatgtatgaggtaggaggaagattttattttctactggtcaaatcacttaatctctctgtgcctcagtttgtcatgtgcaaaatgagaatagtaacagtacctatgtcatagggtggctgtaaggattaaatgagttaataaagatgaaatacttcagaacacttaatttataggccttacatgcatggtagctgttattactgtgatgaaaaaccgccttttggagcattatggaacacacagaaccatgctgaaaatgtcccttgcagattaaaggtattggagagttcgtcacagttctaagagctattaattttttagggggcgtagctggggacataactcctgctactgatgctcatgtgacagatgcagacccccaaatgtgcagtctggggccgcagcggctgagggcatgctgtgaggatgcctgtgctcctgggtactcccaacctatgctccatggctaggagcagcctctgtctgccctccgcagctgtccccgcaaacacaccttgctggctatcaaaaggctcgacgcttgtctggcgtcctaggcagtagctccagctgttcctggccctctggatccccatcctcatcttcccctggcctgcactgctagctccatgtcccaactttgaccctcctggatggtggagtctattgttcctgcacagcttttgggccacgatgattgaagctggcccatacttggattatgaaggggacctacagatacccttgggcctaccaaggaactacctgtatgtgccagcccctggagaagccacttggttctcctgatgtgtttataaagcaaagtcaactatgccacagtcctccaccagctggtcctgtccatgagaatgcactgtgactccctagctctctgctactctggtctaccatgacctctcgcttcattctatcctttctcttctagctccagcaatccaagacagagaagtggaggacgtggtaggggatgctatgctcaactccactatgtgtgaaataggaaggtatggccagagaagtgtcactggagatccagcttccacctcaagaaagccctagaatagaatgtcttttccacaagggaatgcaagaaagtcctatccctctgccatgtcctggtctctcaagctgtgttaatcactcacaatctgcatcctcaagtgtgaggagaagttcaatgtagtcatgtgagactcactgccttcttccagctcccacccaccacattaataccttcaactagcctgaattccctctgcccccaacctccatcccttgctttctgttcaaacaacagaacttactccaactctcttgaatgtggtgaacctctggactctgagtcttctgtcttttaaaatcttttcctttgcctatttcattagcagatgaggatcctcttgctgctcctaggcagggccccacagaaaacctcctcccaagttgccagattgatcctaggggtttgcacacccttttgtcctcctcttccctgccagtgatctgggagtcaggggaggaggtgagtttgctgaacttacatggccatctaaagcccagtgatcatctttgaacttattcataaagatctccacaggccctgtaatctggtacacctggagtaggagatgaaaatcttctttcttgtaagttcctgggaaataaagttcaggtgttacacatgaaagatatgggaaaatttcaaaactcaaatttgtgggtttgtgggtgtaagtttctggatggaatttcatgtgtagatgttgatataaacattctccacatccctttaagtcgtaagtgtagtgttgagtgtgggtttgtgtaggctgaacgtggttatatgcaagaattattaatatatgcatatgtatgttaataattggattaccgggttgaggttgtgatgctattgacacaggcatgtgtgagaatatgattttgtcttttaatctgtccactaatgcatagatagttcaatgggtgcaatagttcatgaggtcctgggcatgggagcatgtgaacatgtctattatcatgtgtgaaatgagcaaatgtcatcctgcagttgcgtaggtgtgtgcacgtatgaatgcgtagataggattttatgtggggttgtgcattaatatgttcattcactcacacatttgcttatctatccatctattcaacaaacacttattttctaaggtacttactttttctgattatagaaagattgaaaattgggaaaattttagaaaatgctgagatgcatgaagaaaaaatgatctctcctgatcttactaagaaataaccacgttactgtaaattattcctgttttctttcttatgaatgtaatattttcctttaaaacactggagtcatattttaaatacattataatgaatgcatttccctcaacactggcataatatttcatctagtagatatactatcattaaaatatccatttctctattttagggaaattttctagttccagtttttatatactacaaatggccttgtaatgggaacagcctttattcataaatgtttgactccctccgtatcttcttatgataaaaattgttagaaatgtaattaatgggtccaatcattttcaaggatcttgacacaaatcgccaaattgttttcccagaatggtaccattttagaatttggcgttcatggctgaacccgacctgcactaagtgttattgtttaaaaacactctgagttgatggtgtaagtggaaaatgacattttgagtttactttttttttgatgattgctgaaaaatattttttcttttgtttgttgactgattgtacttgggatcctgggaagtctctgcccctatttttggttcagtttagggatatcagtcttttctctttgttcataagagttctttatgtattcaggttattaatatttgccatttaaacatttccctttagtccacagtgctttatcatgtaaagatgaatagacacttcctcttccctgaccaccagacaagtctgagccttgcatgacagtatgatgcaatgccattaggctcatccttgccaagggtgtgtgcccatccatcctcccggctttcatagaggggcctgctccttaccagccaagtgcagctccacgccactgtggtcgatcatggtggcattgaccttgctgttggcaacttggaagccagtcactctgagcatggctggctgcttcttcccctggtattcataggcccctttccacagggaattcttggcaaaaacatccccaggaactagaggaattgagaaatagatgtgagagggactttgtgtgtgctgccagaattggggtagcctgatgactgatcccagcccactcactgggattgtttcctttccccaatgtctaccatgtgaggaaggtggtagaatgctctggcctcttctcgtcttgtgtctcagagtggatggatagagggaactgataaatatccactcccatgttcatcgcagcatcattcacaatgtccaagatagggaaacaacccaagtgtccgtgaatgaatgaacaaataaagaaaagggtatatatacatacactatggaatactagacagcttttaaaaagaaggaaattctttcatttgcagcaacatgtatgaactggaggacattatgttaagtggaataagccaggcacacaaagataaatatcatatgatctcacttatatatggaatctaaaaaagttgaactcattggagtagagagtagaatgatggttacagaggctggggcagagtggagggtgatggggagatggtcaaagggtacaaagtttccattagactggagatatgagttttggtgatctactgcatggcatagtgactatagttaataagaatgtattgtacatttcaaaattgctgaaagagtagttttttcgttgagatggagttttgctattgttgcccaggctggagtgcaatggtgtgatctcggctcactgcaacctctgcctcccaggttcaagcaattctcctgccttagcctcccaagtagctgggattacaggcatgcaccaccatgcccggctaattttgtatttttagtagagatgaggtttcaccatgttggtcaggctggtctcgaactcctgacctcaggtgatccgcccaccttggcctcccaaagcgctgggattacaggtgtgagccaccacacccggccaaaagagtagattttaaatgttctcatcacaaaaaaatgataattaggtgagatgatgggtatgttaattagcttgatttatttattccataatgtatacatatagaataacatcacattgtactctataaatatgtttattatttgtcaattaaaattaaaatatttaaaaagatatagagagggaactagaaaggagtgacagaagaagggaggagaaaaggaaaggtgtttaaaagatggagaaatggaagaggggagaagagagagaaaactgacatgtcagtatagcatggtgaattggaacatgggcaaatgaagtcagacagacccagagtctaatcttagctctgtcacttatcagttgtctgatcatgtgcaaaagccttgactttctccctgtataggctatgcctgtattcctatacatggtggccatcccatctaccttatcagggttattctaggggttaaatgactaatgttgtaaattgtatgttacatgatgttgcatgtgtaaaagcacctaatcagtgatagctactaaaattgtcatttatccttgtaatcattctctatggcaattattatgatctctattttactgaagcttaagaggcgaagctcattcgtccaaggacacagctggtcagtgaccaaaatggtactcaaattgagtttctgatgccaaatctagcctcgtttcctgcataatacacatgttaatgtggtaaataaaagtagaaggttcatgaaaggatgtgatagtctctaagaatttggtattggtcaggccacatctgcagtctgtgtccagttctggatgtgatacttggaaagaccccagacctatcttaaactgtaaccatttccaggaagctccctgggtatggcctgggtcaatgtgtttgtatgaccacacactggccagtcctatgccaggaggggctgtagtaatcaacagttccagagcttccagttggaagttgctggctctttcttccagatgaagtttctgcttccttcaggctcactttcttctgaagtctgcctgggctggggaggtgggtagggaaagccatccagatttatagatagttttcatgcccttcctctaggcactcagcaactctcagcaacacgagttttctggctaactgtgtgaaaaaagtaacaccagtttcttgagccaatgatctggaccatacgtactcaaggcttgggtgagcggtggctcccgggcagtgttgatgggtctcccactgggccggacctctgctggggaaaaagagtggaagaaaacaggttcagcttctggttcacactctgttggaaaaataatgaccacctgtctgaccttaggtcaatgggttctttgagatcttgctttccccttattttttttagaccaggaggtagactgctttgatgctctaatgatgctatggatccctctcagaataaaaaatacaaagaattacagaggaagtccattttattagttggagttcttacaatattagacaagacattaggatatagtggtatatatgattctttattactgcattaaataacaggatctagcagtgagtcaagaaataaccataatcttgaagtagtcaggaacatgaacaatattcatgatattggtagcaactggaatatatacaaaagtcttttcaatttctactggtgacaaagtcacaggtgctaacactcctaagggttgttgtctacattccaaattaaaggagaggctacatttcagtaagaagtaaaggaataaaaggtgtatattttcccatccaagtgcacagactccctgaatgtcctcattgaaaactttgcggaggctgaggcaggagaatggtgtgaacctgggaggcggagcttgcagtgagccaagatcatgccactgcactccagcctgggtgacggagtgagactctgtctcaaaaaaaaaaaaaaaaaaaaaaagtcctgccctcgactttgcttttcttccagatgcctcgcatgaaggaagaacttctacccatcaacggtgaactctgtgagtcctggtgggggttgcagaggagcaccttcctcccttggaatgatgagattaagaccaagaagccctcacaggcaaagcaaaggcaaaagctttgggcctgggccagacagccaaggttcaggtcccagcagtgccacttaatgactgcgtgaccttgactagtaacttcaccactcagagtctttgcctcctcatttgaaacctggaaaaaactgaaacatacctcacaggtctatgctgaataaatgaggttatgaacaggaaagtcatgaccagtaagtattaatgtcttttcttcttttgcagagaaacaatagaaaatctgccttgtcgccattaagggcagactccccactgtctgccttggcggggagcacagctttagcaaatctccttcaactctggaggtcagcctatgcctcagtacacagaatgctgtggagaaagtttctgcagtgactcaatgcaagtgtacttctgaacaaaatgctttatcgtcttaggtttcataagatgaatggagcaaagaaggagaaagcatcttatgtgcgaggtgctgtgataggcacttcttcatttcctcctgctcttgaaactctgaagtagagattattttccccattttatagcacagaaactttttgagaggcagagaaatgaaagggcttgctcaagatcatacagtaatgggttgaattcagctgcctctaaaacattatatatttttaaataaaagtagctataataacagataaaaatatttaagaataaatgtaaccaaagaaatgcaagacttgtacactgaaaaatataaagcatcattgaaagaaattaattatctaaataaatggaaagacatcacatgttcatggtttggaaaccttaatattgttcagatggcaatactccccaaattgatctacaggttcaatgcaatttctgccaaaattccagctctctagtttgcagaaattgacaagccaatcttaaaatctgtatagaaacaaaaggcaaaacaataggcaaacagtcttaaaaaagaacaaagttggataattgatacgtcccaatattttttgttttctttcatttaaaacaatttatttttatttagagacaaagtcttgctctgttatccaggctggagtgcagtggtgtaatcatagctcactgtaacctccaaatcctgggctcaagtgaacctcctacctcagccttctgaatagctaagactacaggcatacaccaccactcctggctaatttctttacttttatttttttgtagacatgtagtctccctagggtgcccagactgggacacttgccaatttgaaaacctactacaaagctaaagtaatcagggctgggtggtaatggcataaagagagtcatagagatcaatggaatagaatagagaatccagatataaactcatacatttatggtcaaatgatttttgacgggagtgtcaagacaattcaacagggaaagaatagtcttgccaacaaatggtgctggaacaactggatagccacataaaaaagaatgagtttggattctaacctaatatcataaaaaattaattcaaaatggatcaaagacataaatctaagaagtaaaactagaaaactctaagaataaaacataggcataaatctttgtgaccttggatgtatcacagtttcttagatatgacaacaaaagcatatgcaacccccaaaatagaaaagttagattttatcaaaattaaagacactggtgcttcagagaacaccaacaagagagcgaaaagacaccccgtgaaatgggaaaaaatttgcaaatcatgtaccttataaaggccttgtattttagatagagaaagaacactttcaactcaacaataaaaagataagtcagtaaaaaatggacaaaggatttgaatagacatttctctaaggaagacatacacataaaaaagtgctgagcaccattagccattaaggaaatataaatcatttttgcacaatgatacaggcaacaaaagcaaaagtagacaaatgagattacatcaaactgaaaagcttctgcacagcaaaggaaacaatcaacagagtgaagaggcaacctgtggaatgggagaaattgtttgcaaaccacacatctggtaagagattaacatctaaggaacatatagaaggaactaaaacaactcgatagcaagaaaatagataacctgatttaaaaacaggcaaaggacctgaatagacatttctgaaaagaagacatacaaatggccaacaggtatatgaaaaatgctcagcatcactaaccatcagggaaatgcaagtgaaacccacaatgagatatcacctcctacctgttagaaggactattataaataagattaaagataacaagtgttggtaaggaggtggagaaaaggaaactcttgcacattgttagtgggaatttaagttaatgtaaccattatggaaaacgtatgaaggttcctcaaaaaattaaaaatagaactaccatatgatacagcaataccattatggagtatatatccaaaggaaacaaaatcagtaagtcaaagagatatctgcactctcatgtttattgaggcattattcataatagccaagatacggaaacaacctaagtgtccatcagtggatgaatggataaagaaaacatggaatatatacacaatggaatactatgcagccttaaaaaagaaagaaattctgccatttgtgaccacagggataacctggaggacattatgttaagtgaaataagccaggtacggtaagacaaatactgcacaatctcacttatctgtggaatctaaagtaattgaactaattaatagaagtagagagtagaatagtggataccaggggctagggtggggtggtactggggggttggaattggaaagatgttggccaaagggcacagaatttcagttagacagggaataagttcaagatctcttgtacatcatggtgaccatagttaataacaatgcactgtgtacttgaaaattactgagagtagattttgtgttcttaccacaaaaaatggcaagtatatgaagttaatggatatgttaattaacatgactttgccactccacaatgtatacatatatcaaaacatcatgctgtacactctacatatatacaacttttatttgtcaattaaaaaataattggatgaaaattcaaacaaacaataaaaaacaccacaatgagataccactttatacccactgatcatggatacactaaaacaggatggacaagtgtggggaaggatgtcgagaaattggaccctgatgcattgctggtgggaataacatggtgcaagagttttggaaaactttggcaattcctcaaaatattacacatagagttactgttttcctagatatgtccccaggagaactgaaaacatattaaaacaaaacatgtacatgtatgttcacagaagtattatttgtaatagccaaaaagtggaaacagcctaaacagccatcaacaggtgaatggataaacaaaaagtgatgtccatatgatgagatatgattcacgcataagaaggaaagaaattccgacagatgccacaacatggttaaatcttgaaaacattatgctaagggaaataagccagacacaaaagaacaaatattgtatgattccactaacatgaggtacttagaataggcaaatttacagaagcaggaagtatgatagcagttactatgggctaagagaagggggaaatgggcagttattgtttaatgggtatggagtttctgttcgagataatgaaaaaattctggaaatggatagtggtgatggctgtgcaatatcataaacataactaatgccactgaattgtacacttaaaattgtatattatgtatattctatcacaataaaaacttaaatgtactttaataaatgtactttatatcactactgtatgtggaaaacaaaagaaatttccaagtgataccatgaaaataaaacaccgttagtaagttctagctctgatatagtctctgaccctgaaggcttccctctgagtggcaggatagcaaaatagtcatagatcctaaagttagaccatcagggtatagatcttcagcacttaacctttctcagctggggaccttggacacattaattaacttctctatgccctagtttcctcatatattaaatagcctcataggatcttgtgaagattaaatgagttgaaacatacaaagcatttagcacaatgcctggtatctggtgaggtgagtgcctatcagagagtttaatgctattccagcactgaactaatcgtttaaccttaatcctttccctcaagactggactcagacatcaccttctccaggaagtcctccctgacttctcctttcccccactttagtgcccttcctcctcattcctacagcatttggcacatctccatgttcctccaagtactccaaatataaaatctgataacgtgtctgtcttccacatggcagggttgtgtctttcccctctgaatccctcatgcctagcgcaagcatggggccacatgaactctcaataaatagagaacgagtgaatgaagaagaggggaagggaggtctgggacatcctggtaaccccaagggacctacaggcgggtgctgttttatcaagggtgcaatatgtgtaatgcgtcactccagtttggtggaagaaagcactttcctctgcctgatgatgaaatgtgatcctgtgagtgtttcagcccaggcaaaaggggcaacccttggggtgggttgagtatgcacctttttagaccgctctgctttgctcttctagactcaaaaccttagaaaatcagaagcgggatccagctccttgaaacgcaattccttccttctcttttgccctctttcagctcaagttcagccagcactttcagcctcccgccctggagagcttccccgagcaggcacactcacccaggcagatgggcggcttgcctgtccagctgccatccgccttgcaggtgcggtgctcggagccacccttgagggagaagccctcctggcaggagtagatgagcgtgtagcccatggagggcaaatccagggccccgacgttggcatgcgttggcgtctctggctgcctgcagtggtgggctggatgagaggaaagaccctgttggactggaggagattaggggcttcaggggccctttcgaccattcccctgttcctagatagaatatcctcttcctttcccttccagtccctttcatgccaagcatccccctccctaatcctccaccctaacccaagctctgtgtctagaggaatggccaagatggagatcatgtggatatcggcttggttgactctgagttgggggaacttaagcctgcagcacttcctgaggggtaaaggagtaactgggtcaaaagcttgatatctccatcctgaggcctggccttgcagttgttagtttttgctgctgccactggatagttttttctttgctaaggcatagggattgccttccaatatcagaaaggcttttgtgtggaagtcttctgtgaggccccaaagtgtaaggactacaaagagaccgatgtcggttcgcatggggagttgtgaactccctgtcattcagagcattcaaacatgacccagatgcccagctggggcaagaggaattttcttgggatgtgggtgaagtctgcactcacggacacagtcaggtggggttccactccaggtcaggtttgggaggcaggtcctggtggtggagccctgaagcaggtagcctttttgacaacggaagaggactgtgcttccaacctgcggcaagatacaaagtcccatcagccccttcctttcagcggtgcttcctacgtctgtcccttgaccactttcacatggcccaactcctcccgcactgttgcctgcaaaactctttttctgattctccgcctggttaaattttcttcttcctttgaggcagttgataggatgcctcctccacaaggcctcatctaataccctgaacaaagttgtaatattacactctgttgtggacacggtggctgattcagagtcagaagaccctggatccgagttctggcttctgcatttactcagggcaggctgcatggaactctgtaaaccttagtcttcctaaggatacagtggggatgaccatccttgccacaatcacactggaatgttgtgacactcaaatgtgatggcggatttgacagcattttacaaaatgtgaagaagagtgcaaattaaatattgtgtgtgtgttcctttcctcaatgaaattgcaaattctttaaggatgggagacttgtctttacagatatggcccccatagaatctgttgaacgaactgccaccctccctccctgctctgctcagttatgttccctaccttaaccctccaccagcccctcactgtacaactcgacaccccgcaaccacgggctccatctctccctacccaatccacttggtgtaatgcggctagatctgtttcctatactgcaactcggattatactacttcccagttcaaacacttatgtgtccctattacctactggagcatgtgcaaatgcaatgtgtaactcttaaattccactcccttcttccatgctgaacacttttttgtcttggatttcatcatttgacttagcaaatggcacctttatccatgcagttgtgcaaataaaaaacctcaagtcatctttgatcccttcgaccccacaatccaacccatcaatgagtcctcttggttctgcctacaaaatgtatcccgaacaagcgttcaggatcacttctcaccttctttttccctggagtcatgacaacagtgtcctccttgcctaagtgcatctattctcaactccctgatattcattctctactcagcagcctgagtaatatttcaaatgaagaatcagattgtgtcaccttcaaatggcattttagataaaatccaaaatacttatcatggcttcaaggccctgcatgacctgtcccatgctgccgcctttgcaaaaattatgtgatatccgacatacacaaaataatatatggaacacatataaagtataataataaaatggatattttagattgaatccaccatgcaacttaagagctatggacatggttgtaatgttctaggggctctttccctgctgtgttcctcaacacccctccgtagtaatggctgtcttgaaatttgtgttaatttccttgccttgttaaaaaacaatcctatcacatatgtgcatacatacctctaaacaatttagtaagtttttgctggttttaatatttgtaaaagtagtgtcatgccacctttgtcacttgatagtatgtttctaagattcatccatgtcatgcagagctgtaattcattcattttctttgctgtataataatccatcacgtgactatacccacaaatttcctgtttcttggtgacatgtgcaagagtgcctctgggatatgtttgcagaggtggaacttttgggtcatagagtgtgtgaatgtttaactttacacaccaggaccaagctgttttccaacctagcctcactcttgactacatttccttatcctccctcacggggctgcagacttgctagctggcctactttccaggcccccaggctgctaagcacttccctcagcactcctttgcaccagcccttcgttcagccaggaatgtcaccctgctctgcacagggctagcccttctcatcatggaggccgtagttcaaatgtcacccttccctaaccacctttcctaaaatggtaacccaccccgttcacacccctttatatcaatcaccgtgtcgtgtctactgctctcagaagctagctcgtttatttatttatcatcttcagccaggcagctcccttcaaacaggcacccagtctgtcctgttcccactgtattcctagctcctagaacagttcagggccataagcatgtgccgagtgagtacagactaagtgaataagtcacattacttgactagatcccagcctgtcatgtccaggtgagtccgatattttcctgggcaagtcctggactccacctaattgtcctgccttgaacacacccattcttccttttcttttctcttcttttttttctgagaccgagtctcgctctgttgcccaggctggagtgcagtggtgcgatcttggctcactgcaagctccgcctcctgggtccacgccattctcctgcctcagcctcccgagtagctgggactacaggcgcccgccaccatgcccggctaatgttttgtatttttagtagagacggggtttcaccatattagccaggatggcctcgatctcctgacctcatgatccacccgccttggcttcccaaagtgctgggattacaggcgtgagccaccgcacccggccatccttttctctgttcaatgtgtcacaacccagactgtccaggttctctcctcccaaagctcatctgaggtgtgtccgcagggcctgtgtcctggtgggccaggcatgccaacaggcctgcctcctgtgtggcacatgctcgttgccactgtgcatgagcccagtgtctgtgggtggggtgggcaccgtgaggacagaggtctcactcatttccgtatttccacaaccaccctgcctggggttgccgggaagtgttcatggaactgcacgccatctgtccttcctcatcagtttctctgacggatgttagggtcctgctgtctctgcagggtgctcccatggagcactgttcaaagaggcagagggctttctttctgcgctttccaagctcttgtcctccctgagtgctgtcctgaggaaggtctctgggtcctcttatgttgacagtgacaagaagggataggatgtaggaagaccctatcttggctgacctccttacctggtagccctgagaattgttctgtatcccaaactgtggcacaccagggtccgcacacgtggtcagggtcggatctggatggccaaaacaaagacacagatcacatggtcatggaagccttcacggcctcatctcactctgggaaataggtgtagaaaagaaaatgcggccacatcctgacttccctgcccactgagatccccacctgagccttggccctggctgtctatttgactcctcgaagcacactagctctggctattttacatcctgctgcagaagctcagaggatgagatgttcccttttgcagatgagaccactgaagacagggaaggaaagtaatcatctcaggcccaaaagaaggtctcccgcaaccccagccaagacgctccctgctccagatgacctctcacctatgcagctgggctgggtgccactccatgtcccatctgactggcaaaacctgcgtggagagcccaccagcaccagagggggatggcaggagaaggagacagatgacctgtaggagaagcctcggtcctctctcctcccacgggacgggacaccaggatccccgcagaacacagctgggaagacgaagggagaaaggcaggtctaagttgctttccagaacccaatcttccagtcccacacccccatctttgttctttgcactgctcccttcctggttgagcttgaactctgggaaccggggcagccccaggtaggtgcttccacctgctgcggtgctgctgctgatgggggcttcctctcccttctacattcaaagtgcctattaataatgatccaagtaatggagtaacattacaggaagtttagaacatgaaagagaaataaacgaaaatcccactattcaaaactttttttccattttcacgcacattcttttccaatctttgttcagttgtatggaaacttgtgcggagcggcaaacccaagcctatgtgatcgtaaatcttgtttcattcacttagcattatcttgtaaatatttcctatgtttatgacatcatcatcgcttattggctacacaattagcaacaggtggttgtaccataattatattttatcataatccttatattgggcattttctattatacagttatatataactcttctttcacctgttttgttttcttttttgttttttcttttcacatgtattactttcttaggagaattctctaggagtgaacttattatttttaaagggctgaacacatccacagctcttgatgggtagtgtcaaatgtctttccccaaagggtacacatttacactgcggtgggtagtgcatgggtgtacccatttcattcaggccatgttaacatcaggcagtgccattaaaaattgactaccaaaggcaaagctcaccacgatgtcacttcaagcattgctttatgctatgatgcaaatgtgtgtgcgtgtgcgtgtgtgtgtgtgtgtctgtgtgtatgtgtatatggagtcatgagatacataaccacatgcaaaataaaatgaagctggacctgcatcctctgccctgaaggttggggtgtctatgctgaccaattagaagtcagtttaagaatcgattgatgggaagttactgtatccagaaggaggcaactgaaagaaccagaaacacaaacggctgacaagtgaagagcaaccagcgtggcctttctcataagcaatgtgatgccaattaaagtaatgagcgatcttttaaagctcctcaggctggtaaatatttaaaaatactggcacaatccattattgatgagggtgtgcatccagaaacattctcattaactgctgtggggaatgtaaattgggacagtttctagaagacagtttgacaacatatgtcaagaagggaggcatgactgccctcggcccagcattctcatgcctagggctttgctgcaggagtaaagaaaggcatttttttttttgagatggagtctcactctgtcgcccaggctggagtgcaggggtgcgatcttggctcactgcaagctccgcctcctgggttcacgccattctcctgccccaacctcccgagtaggtgggactacaggcgcccgccaccacgcccggctaatttttgtatttttattacagacagggtttcaccttgttagccaggacggtctcaatctcctgacctcgtgatccacccacctcggcctcccaaagtgctgagattatgggcatgagtcacctcacccggccaagaaaggcaattttcaggaatacatattgcagaactgcttctaacgtgattaagttggagataatctaaattcatcaccagtgcaaaaagattaaataacttgtatctacaaggaaattctttaaagccattaaaaatgatgatgcatagatcagtaaatattgataaagaaaggtagaaaggtattgatggaaaggttttggtggcctatcagtgaatacaagttatgaaacagtatgtacagcatgagccaataccagttctagaaaatgtatacatatcactatctattcaaaaatgcacagtgattcacacgggacaccatcaaaagctgaactgtggttatcattggaaagtgtgagttcagatgacttttactttcttttttgtattttctaatgggtaaaatttttttcatgatgaccataattcattgttaaaaggcacttcagctatttctccagaggaaaagcaaggtggctgagtccagacttgaccctggtagtatgtgaaggttggaaagggtaacattgcaccaaatacctgtgtccagttttgagctgctggccctaatctctgaggaaatccccagatggaagcaaattttcagaggaacccaaaacagtatcatgagtatgtggatagttttctgcagaattagataaatggcaattagaaaaatacgtcctactgtttgcccaaagcacgggcatggagaaaaccttccagagcccattcacagggtgtgacaagaataagtgacccagaacctgcttactggggatctcagtaaagagtaagccctggaatagatttggggctcctcaggatacaactgggccaggtgtataaaaaataaagcaactcaccagaaaatcacaggtttcccagaagtcttttctgtgcaggtcatttttcatgaaaacagacatgtatatagcactgggaaccctcagatcttggagtactattccatacagttaacaacccttcaggtaaaaaaaaaaacacccccaatatctctagcttaatttccttctgttaccatagacagtatctgacaccagggctcaattaagggatcctcattttcttcctttccacttccttccctctttaatagtgtctttgatgaagctcctccctggttttggggaggggactacctattctgggccttccagccacaaagctccgaggaggcaaggggaaggagctattgaagaggatgcaccaaaggcccttgtaagcaacttacggaaacactgaggcagctctccggtccaggacccatttccctcacaggtgaacaccgcgggcagggagagctggtacccctccaggcaggcataagtcacacttgagccccacatgaagtcagaccccaccaccttcccattggggatgagcggaggtggcttgcacatgagagctggagggagaccaaagcaggctgagttctgatgctgtcctgggaaaccagcccccgtcaccatcattgatatcaccgactaccctgcacccacctagagcctgggctaaacaggaagaaccagaatggggccctcttactgtgggagttctgatctttttgcaccttacaatgccctctctcaagtgtgacaacccagtcctctgtttgcgggaccctcccctcaatgttcatggcccaggccttattttggtacttctgattcactcctggcagatgttcaggggccagttttctcaccttgcacatcccctgataagatgttagggctggcctttcacccctctcccttctagagagatgctcagggcctacatctcacttttgtatcttctttggctctctgtccacatttgcagccccagacacacctttgcagacgggcttggttccattccatgtccggtccttggtgcagctcagcacagatactctatgtgactccatcatatagccagggacacactgatatgtcacagttttgttgtacctgaagtcattgcccagccgaaggccattggctggaatcccagggtcaccacagtttatgactaggataagagagatatagcattgttcactcctggccaggaccccacttctcctccaataccatccctatcactccctgcatgcatccaagaagggaaactgtcagatcagggatgccctgtctcctcacaggatcccagttggacattacccattctaaatttctttttttttaagtcagggtcttactctgtcacccaggctggagtgcagaggcacagtcatggctcactgcagcctcgaactcctgggctcatgcaatcctcccacctcagccttctgagtagctgggactacaggcatgagccaccacacccagcttgcccattttaaattttgttttgtcaaatccctggcatcagtcctgtccttgcccacactgtccttatgcaccgctgcaacttgggctatgaagattcaccttattcaaagtgccccctctaagaggaagtatccagagggctcagttcctaaatgaggctaggacccagggaaagggagttttctgtttgaagaacctaaggtatattaatgaaccacatgagacaattgatttgtctgctgaggggtacatcttatcacctgctgttgtacctacgaggcctctgtaggcccaacagcacctacacaggactcctagggacaacagcctggaagcagggtcttatggcccatgaaagggtcatgcctatgtcatcatatcattgagggtggggcttggtgagctctggtctcaaaaccaaagtgaacttgacacgggatttcagagggagtcgaaatcacagactaggactttgacagggagaatcttgtcacatttcctcatcctatctcttccctccatctggatcccacagtgactcacttttcccagaaaagaactgggactacccttgagagaagcaagaaattggagctgtgaggctacaccgtgctcaggaacccgtactgggtggggtcgggtacaaggacagaacgaagcaacaaagatggcagatagctgcatctttgaagtgaaaagagaatcaggttgagctctggggtttgattctaagagataaaagggaaagcccaaggaattggctagagcctgagaaatggccaacatatattctctgcctctctgagcctcagccatctcatatacaaaatggggataatagtagctacttcacggagttacggagttatggtgaagatcaaatgaaatgtgcatatgaaataaagtacttcgctcagtggctgccacatagcatatgctcaacagaggctattcatatgattatcgttcaggttcaagtccgaccatcccaaccattctgcaccatcttccatggatagccttctcctctggcatgcaggatctgggccactgttggccatggaacccgtagggcctgagctctcaccgaggcactcagggtcactgcctgtccaggtaccattgaccgagcagtgacggctgagcaggcctgtggcgtagtatccttcccggcactcatagacgatagagctggagaaaaccaggccatcactgaacacaactcgggcattacttggagtcccagggttcccacaagagatcactaggaagacaaaaatacacattattcaccagaacaatggtgggtatcacctaggggactgataactgcccagagtggaagccacatgctacctcgggacctcgtggatagaaatgcctctcatgctgcttttgtatcgaattatcttgcccctagacaggaaggagagacccctatgaatcttttgaaatttctgagcaaattccagttttttacagaaaaaagatgatctattctattatcgtccttaaaattttaaacacaattgcttaatatcaccaaatatccaatcagtgcttgattttcctcagttgtttttctctttttttaacagttgatttgtttgaatcaggatccaaatagggtccacacatgacatttggttgacacgtctctaagactttgaacccagagatgattatttctgcttctataatttatttgttacagaaaccagaacatctgtcctatagaacttcacactttctggattttgctaactgcatcaatgagatatagtttaacatattcctctatcccctgtagttccttcctgtaatcaagttccgccttttggcaatggtattcataggtggttttgggcctctcctattgcattggataagaagcaaagaatgtctgggtgttttcttgttcatgatgttgaggctcatcagtgatttcgggcatgcctgcctaatgtggcattatgaagtttccattatgaagtttttcatttaatagttttagcagtcattgaccagattcattatttcattagggattggaaagtggtgatattctaattctatccttctttctgcattagctagagttctttaggaaagacattttctatcatcaaatatttgcttaccctgaaatactgttcatataggaacgccagataatgcttgattttttgtgtgtggtttttattttaaatcaaatgtcagaataatgagttggtttcctagcaaactccaaaggtgaccaatgtgtttatttaagaatcattttgaactcatggatctaaagatattttttatgttcccatccattgccattattattcttattgatgctcagattctccatctttagccaataggagcctcttctagttggctcctgagtccagttaacatgacctcagttatctttggtggaatcctcgctggagtgacaagatgttccatatttgtcttttttttttttttttttttttgagacggagtctcgctctttcgcccaggctgaactgcagtggcgctatcttggctcactgcaagctccgcctcccgggttcatgccattgtcctgcctcaacctcccgagtacctgggactacaggcgcctgctaccacgaccggctaatttttttttttttttttgtatttttagtagagacggggtttcaccgtattagccaggatggtctcgacctcctgacctcgtgatccacccgcctcggcctcccaaagtgctgggattacaggcgtgagccaccgcgcccggcctccatatttgtcttgtatatttcctgcaccagcccgggaattagccatttctccagagagtctagtttcttttaatggagaatggaccacaatccaggcagtaagagtactcattgccactgatctggtcattgattctagacttttagagttagagctgtgaaaataacttcttaaattgaaaatacatggggatcacgtggaggtagagagtggaaaaacagataatagagcctgggaagggtgagtcaggggagggggaggatgaagagaagtgggttaaagggcatggacatgcagttagaaagaaaaaataagttcaatgcttgatagcagagtagggagactatagtcaaaaatgtattgtacttgagtgatggacactgtaaatgccctgacttgaccactgtgcatttatatatatatatatatatatatacacatataatctctgcctcacattcaccctcttttcccttgccacttctgccaatgtcttagttgcctgtcaaatctccagctctgtacccaatgcactgtctgctctgtgcccacaactaggtagcaaaatgagcttgaacaaaaacatggtcccatgctgactgctctcactttaaattaatgatccccccaccttaagtgagcgctcagtgctgcctggccattacacacttcccaattccattccacttgtatcttgctaaatgattatctccttcctcttccagatcttctcactcaaacttactctcatctgttaagcctgcttcctgcctaggagagtactatgcaagctgtattttagaaagagagagacagagagatttggggaccaactgcaagaggagagagagatttaaaaatatacattttccccagaaacttaggaatatatggaaaaatgataatttctcccattggtgctacctcaggcaacatcactgagggcctagattactttgagagttttctaaaattggatttgtatatcttttggcacattgaatatttgtttcacgtagtctcttcccttagactgtaagccccaggagatcaagatgtgtgtctccgtctgttcaggcttggacatggtgccttcttgctgtgtcttcacatggcacaagggaaagggagcattctaaggtattttcttttctctataagagcattaatcccattccatgacctaacaacttcccaagaccccacttcctaatactatcactgggtgaccaggtttcaacatatgatttttgggaggtcacaaatatccagaccatggcagtgtccgtcttggtcaccattgtgtccccagcacattccacagcacttggcacatagatgctgaatgaaactatatgggaaatgaatgaaatagtgggtcaaattcagtcttttttgatttcttcccttttgaggtgagagtgggaatatgtttgtcttttgattactaatgaaaatgcacatgaattatctgttgcagtcctatcagccaggctgagggttcaaatggggccacggtttttttctgtgagcgcaggtgcctgggaataagagcaggagcaggggcgagctctggggctgggcaaaggggagaagcagaatggtcacatacattacctccacactcaggctgcgagccgctccacgagccattggcttgacaggtgcgctctgacgatccccggagcacgtggccagcttcacagctgaagcgcatcacagtgcctggatcaaagctgtcccccaaacggatgccatgagccgggatcccagggtcaccgcaaactcccacgctggttcctatggaccagaaccacacaaatcccattatttttcagggaagaaaagggagtggagaagcaggggagaaagatactgggatgggactaaggggatgcagtgggtcccacgaatgaggcctagcacaagttacctgcacatgctcctgcctccatatgcaatggtggaagaacacaaagatctgaggccatgggtaagtccctgggaaccacacagggaggggaagcaagaaggcagaggaaaggctctgtggcccgtgccagtctggaatttcagtgatccaaactggccacaggtcctccttctccccttcccctcttctctacaaacacctgctgattctgtagtcccatctcctctcctgtgccactgtcttagcttagacattcaacattcttttgcctgaactcttgcaagagcctcccgactaatgtcccctccttgtaaactctccctctaatccatcttctactttgtcctctaatcttaacaatcactaaccatctgacctttttttttttcaaaaaattttttcctgcagaaacatctttactggctccccgatgccataggataaagtccaaactgcttagcatagcttcatttcttaaccgcctagcttgaatcttgatcttgggcatttatttatttatttattactttttaaaaagtttcattttatctttaattgacaaataatcattgtacatatttatggggtaggaagtgatgttttgatgcatgtattgtatatttccaagtagctgtaggagagaattttaaatgttctcaccacaaagaaatgataaatattcaaggtgatcgatgctgggcctttcattaaggattccctactcacaaattatgccatacaagtgagctctagaataaacatctcagaccctctcatttcatttttgcttcacccccttcctcttgctacattcctacatttctctggcttctggtattgtgcaaacccactcaagagacctccaaggacccaaggagcgaagaagggtagagaacaggagacaaagccacaagatctatggtcccctgcagggccaacacatttcatgatacagaaatgtgtaggagatgtccttagatcagaccaggccatggtaaacatgaggaaagaggagaacaattaccgaataaatgacaactgcatgaaaagataaagttacaactatcatggaatctatctcctcatgtaaccatgtgtgggcatcaaatggtaacatctgagtgaccacatctagttggctggagccaataaatgtttaagtcatgtgtaccccaccacttgccatttatgtcttttccacttctcaaccttgggattattccctttcctagtctcgactcagactgtgagacactacctaaccacatgttctccattctgtttcccactgtggaagagggattcattttcaaccttcaatgtaaacattaataaaagagagcttatcgcatttggctaggttttcttatcttttgaaggttgccaggatgtaattcacacaacaggcagaactgggtctccctggaaacaatcttgatggtgagcagctctaacccacacactggctagctaacctcagctggagctagcactattgtaaaataggcacaagatggttaacgtggtttggctctgtgtccccattcaaatctcatgttgaattgtaatccccaggttggggaagagacctggtgagaggtgattggatcatggggtggatttcccccttgctgttctcgtgatagtgagtgagttctcatgagatctggttgtttgaaagtgtgttgcactttgctctccctctcctgacagccgtgtgaagatgtgcctgcttccccttctgccatgattgtaagtttcctgagaccttcccagaggcagaagcctgtacagcctgcagaactgtgagttgatcaaacctctgttgtttataaattaccaggctcaggtatgtcttttggcagtatgagaacagactaatacaatggtgttcagtcctaggggctttttctgaaagaatggcccccactacagtattggaggcttctagttcagtgatggaagggagtctggacaggatattgcaccatgggggcagagtagatagatggcaactatttaccgaagaggcaaagagaatgacagtggagatgtgggtggtgaacttcttgaagtaggtctcaaactccagaaatctctccatagccttggtggcccagtggtgtatgactcaaggacttaagaggttttgttgtgcaacagttgggtccactgcttgcacacaatgagactaaaaactttgacctggaattcatgaatgtgtatttcataggactggcaggagatgccactgcaaaagacgacattgtttcaggaagggaggaactatctctatatctgtggtatatacctaatgttacttcctaattgcctattcttctcatcccttatgttctcatccaagggatttaaggttcactcattgtctagcctttgcgtacattgaattccttctaattctgttttcagagagctccagggaggctggagaggcaatgtacatgacccttgtcctctcatgctgtattgcctatcacttctaccagatgtccaaacagaaagaagccagggcacagttaataggccttcctctagcccagctaaatgagtcatcatggctcctatatagtcctgcccggttccttaattaggtgtttaatgagattaataggggtgagaggccaaagtcctgggtggtcatatagagtgatgtgtctgggatttcctgggcaaccaacagccctttgaaatagtggctttgggactcttttctttctggagagatctaatgaatatctcattaaatattctggcagtgacctaacttttgggaggcaggctcatctgggaatgtcaaactgcaagaacagtggcacatcttatgggtaaggtcctacatcaaggagaaggcttctgtattaggaggaggtcatgatcctttcctctgaagggatctggcatgggaagggttacgggttaatttcaatgccaaggtgggccctccgaggaacatcaagctgcacaagcagctccctcttgcaggcaacatggaatcccttcctagggccaggcaggtccccctcaaagaagacaaagctgcaaggcactaatattttagcttggtggtttctgctattggcaggacaattcacttgcaaaattttgttctgctatatggcattacacattcatttctggtttggatactgtggacataggacctttggcagttctctacatttgcgattttgatagcatctgtcagtgtcctcattagcagtaaaaggaacttaacaggaaaagtctggggactggcgtttcaaggcagtagagaagaagactgtaccccactaggtagccaggacataggacaagttgaggggcagtgataagaaagggaaggaggctggggcctacgagtctgaaacagagaagaaaagaacacaggagtgggcttggacctgagcacgagtctgaaacagagaagaaaagaacacaggagtgggcttggacctgagctgatcaacaggaagacttgaactgtccccaggaactcataaaatcaagtgtctggacaggactctggccataggttgacctaaaaagttgtgcccctcctagttttgcaatccctgggcatggtcagggctgactgaggggataaggcagggctcagcccaccagaagctgaagctccattgggaccttgtcttgctgtgctttctacctgttagggtagatataagggttctgaggtctgattccctcccatccatcaatcacactcacaccttgggggctcgtctacctcccatcagtcaagcattccactggagctctttcctcaatgccatgcaccatacctgagcagtgagggagggagccagtccagtgtccatccagcccacacatgcgggtgctgtttcccaccagagtacgcttgccgatgcagctgtaccgcaccactgctcccacagtataactgtctccagacatctgggagtgaggcggggagcccggatggccacaggacaccactgtgggggaaaagcaaacatctcaatgactctgcacagggatggctcaccatcacacaatccatgctaggcttctttaagcaagaggctgggaagaagagaaacccaagggtatctgttgaagcaaacttcctgctggcatgcccacctggcgttggcagacaatgtccactcaggggacagttttccatatctatgaaatgaggaataataccttctcagcatgtagcagatatacaataacattagattgttttctctcttgcctcttatgcttacctctccctatttcctcatactcatgatgtctctgggcaggaaggtggtacgcagagtatacacaagacaaaaatgggagctctgtcaccctcagattgtcttcattggccaaggattccagaatgaaagccaattatagcccttttccatctgcatcttacagttgcctcatcagttgtccccaacctgtccctctcagtatgcaagttccctttactaaaatactgaagtatagctgtgaaaacaagtgagaagatagaacaccagaattgagatgtctaggcaagggtaatgctttcaacattactggggctggtcttcccattggtcttgtcacaggatcacaggttgatcctaagattctctcatttactcaacacacatttattgagtccctgtcatgtgctagacactccgtgtgtttgggaagatcaagtgactttgagaagttacttgaatgatgtgaagaggccagccatgcaaaattttggagaagagtattgttggggatggaacatcaggtataacgggccagaggccagagtgagtttgctgtgtttgagagacagcaaggaagccaaggatgctgggactggaatgagccaggacagaatggaagaagacaagggtggagaggtcactatgagccagatcatggcatgaaaattggattttattatgagcatcttgggaagccactggagttatatgatcggatttacattttaacaagattatactggctactgtgtagagaaaggaccaggtggtacaagaaagagggagctgttgcagtagttcaaggagagatgataatgtcttggagtctggtaggagatccctgtagacatcatacccagaaagcccacagggcatagcatacaggcagaccacaacaggtgaccaagtggtaaaacctgggttgggccagtgctgaccctgatgatgaattttggtaggtactgggatggtaagaatgggtcttaggtatcttcacttctcaatgtggtcttaatatgggtcaaacattgttctaaatgcttatggtagattatctgcaaagactgctgctactaacaattcctcccatcaaggagtggagtctttttcccctttcccctccccttgaatcaggctggccttgtgacttgctttgaataacaaaacatggtggaagtgatgttgagccaggttacatcctaagaggcttggcagcttctaccttccctgtttggagtactatgccaccatgtaaggaagtttggcagagactacggaatgacaagaactcatatgaggggagggaccatggacaatcacaatgccccagctgacagccagtgccaagatatgagtgaggccatctcggatcttctaggcccacctgagccacaacagccaataacatgtggggcagagatgagctgtctctactaaaccctgccagaattgccaatcataagcaagaaaatggctgttgcattaagtcactatgatttgttacacagtaaacacataaaaatatgcttaacacgattcgtcattagagaaatgcaaatgtaaactacaatgagatagcactttgcatccactaggatggttataataaaaatgatgaacaataacaagcataggaaagaatatggagaaattgtaatccttatacactgctggtagaaacggaaaatggtgcaaccactttggaaaacagtttggcagttcctcaaaaagttaaatatagagttcctatgtgacttggcaatttctctccaaggtatatgcccaagagaattgacaacgtgttcacacaaaaacttatacacaaatgttcaaaccagcataattcataatagctaaaaaatggaaacataatagtcccaaagtggaaatgttcataatagtcccagttcatctatcaattgtcgaatgcataaacaagatgtggtatattcataccatgaaatagtatttggccaaaaggaataaagtattgatatatgctaaaacgtggatgaactttgaaaattttatgttaagtggaagtagccagacacaaaagacacacatataattccatttatatgaaatgtccagaataggtaaatccacagagacagaaaagtacattagaggttgccagaagctggggtggggtgggcaatggggagtgacttttaagggctgcttgggaatgatgaaagtgttctggaattagacagtgatgatacttgtacaactttgcgaatacactaaaatcactgaattgtatacattaaaagaatgcattttatggtgtgtgaattatatttcactaagaaaaagaaagaaaaaatgcaaatggattaaatcctccacttgaaagaaaagattgtcagatagggtttaaaaatcacaattacatgctttttacatagagagcagttaaaaataaaatgataaaaaaatcatgccaatactaaaagaaggaagctggttataagttacaggtacacctagttttattgtgtcttgctttagtgtgctttacagatgttgttttttttacaaatgaaaggtttttggtaaccctgtgttgagcaagcctaacagcaccattttcccaataatacgtgctcacttcatgtctctgcatcacattttggtaattctcacaatatttcaaacgttttcattattgttacatctgttatggtgatctgtgatcagtgatctttgatgtcactattgtaattgttttggggcgccatgaaccatgcacacataaaatggagaacttaattgataaatgttgtgtgtgttctgactgctacaccaactggccattccttgtctatctccctctccttgagtgcccctattccctgagacccaccaatattgaaattaggccagttaatagccctatgatgtcctctaagtgttcaagtgaaatgaagagttgtgtctctcactttaaatcaaaagctaggaatgattaaaagcttagtgaggaaggcatgtcggaagctgagacagccctaaagctaagcctcttgaatcaaacaattagtgaaattgtgaatgcaaaggaaaagttcctgcaggaaattagaagggctgcttccgtgaatacatgaataagaaaatgaaacagccttattgccaacatggagaaagtttgagtaagtctttattgtagggggctgtcctgtgcattgtaggacgtttagcatcgtccttggcatccacctaccatggaaggtaggtagatctggacagaagatcaaaccagccacaatattcccttaagccaaagcctaatccagagcaaggccctgaccctcttcaattctatgaaggctgagagagttgaggaagctgcagaagaaaagtacaagcaagcagaggttggcttatgacgtttaaggaaagaggccatttctataacataaaagtacaaggtgaagcagcaagtgctgatgtggaagctatagcaagttatccagaagatctagctaagctaattgatgaaggtggctactctaaacaacagattttaaaggtagaaaaaacagccttttttttttttttttttttttttgagacagagtcttgctctgtcaccaggctggagtacagtggcaccatctcagctcactgcaacctcctccacctcccaggttcaagcaattcccctgcctcagcctcccgagtagctgggactacaggtgcacaccaccacgcctggctaatttttttgtattttagtagagatggggtttcaccatgttggccaggatggtctgaatctcctgatcttgtgatccacctgcctcggcctcccaaagtgctgggattacacgcatgagccaccgacagccttctatttgaagaagatgccatccaggactttcatagctagagagaagtcaatgcctggcttcaaaatttcaaaagactgaatgactctcttgttagggatgaatgcagctggtgattttaactgggagccaatgctcatttacccattctgaaaatcctagggcccttaagaattattccaaatctgctctgcttgtgctctataaatggaacaacaaagcctggatgacagcgcatctgtttatagcatggtttattgaacattttaagcccgctgttgagacctactgctcagaaaaaagagattcctttcaaaataatactgctcattgacaatgcacctggtcagccaagtgctaaatgatgaagagctcctgtacatcagaactggagatgtacaggaattgaatgttgtttccatgtctgctaacacaacatccattctgcagcccatggatcaagaaataattttgactttcaagtcttattatgtaagaaatacatttcataaggctatagcttccacagatagtgtattcctctgatggatctgggcagagtatattgaaaaccttctggaaaggattaatcattctagatgccattaagaagatttgtgattcatgggaggaggtccaaatatcaacattaacaggagtttggaaaaagctgattgcacccctcacacatgacttggaggggttcaagacttcagtggaggaggtcactgcagatgtggtaaaagtagcaagagaactagaattagaagtggagcctgaagatgtgactgaattactgaaatctcatgaccaatctcaaacagatgagaagctgcttcttgtggatgagcaaagaaagtggtttcctgagaagaatcaggaaactacttttggtgaaaatgctgtgaacattgttgaaacagcaataaaggatttagaacttcacatgaagttagttgataaagtggcagcaggatttgagaagactgactgcaattttgaaaggcattatactgtgtaggtaaaatgctatcaaacagcagcatacgctacagagaaacctttcatgaaaggaagagtcaatccatgtggcagacttcactgttgtcttatttcaagaaattgccacagccacaccagccttcaccaccccgatcagtttgcagtcatcaacattgaggcaaagtctccaccagcgaagagtatgacttgctaagggctcagatgattgttagtattttttagcaataaagtatttttaattaaggtgtgcatattttttgacatgatactactgcacacttagattatactggaaaactaaaaaatttgtgtgacttattttattgcgatttttgctttattgcagtagtctgggactggacttgcaatatctccaatgtatgcctctatattaatatatatacctattagtaatatcaacagcaacattaacaggagtttggagtaagctgattctaaccctcatgcatgactttgatgggttcaagacttcattggaggatctcactcctccactgaagcagcatcaagagaaccagaattagagcagcaagagaaccagaattagaagaggagcctgaatatgtgactgaattaactttagagaaaacaagcattgggacaaaaagttaatatggatagggtcactttattatgataaaagctgcattttactagaagaaaaaacaatttgagtccactaggggctgtgactctcagctggcaccactgtacacaggtggtgtccatttctgaccccaaactatttgctggtcataaatgggattggatggccaggccagagttctcaagcgaggaaaatacaagcagtgagcagctataccaggctcctgttagacctacagccacgagggcgtaaaaaaatgcagttgtccagactggagggcctacaaaatgtatataatctgccaaaggtaggtggactgctgcatggccttaactgcatatctattactccctcttgagtgcatcttcacctttgcttcttggaagatgggggagagagaaatctatgtggattcacctttaggaaacagaggggagagcaggaaaccaaggggttgctcttctcttaaggacgtgtaaggccagggaccagatgtcaggtgatatggtttggctgtgtccccacccaaaccacatcttgaattgtagttcccataatctccacgtgttgtgggagagacccggtgggaggtaattgaatcatgggggcagttaccttcatgctattctcatgatagtgagtgagttttcataagatctgatggttttatacggggcttttccccaactttgctcattcttctctcccctgccaccatgtgaagaaggacatgtttgcttctccttccaccatgattgtaagtttcctgaggcctccccagccctgtgaaactgtgagtcaattaaacctctttcctttataaattacccagtcttgggcagttctttatagcagtgggagaacagactaatacatcaggattctgagcacctccccaaccccttttaaaaaaccagttgtccccaattcttttcctaacaataattaatgtggtcattgtttattgagtagctactatgtaccagatactatgctgggacttttaatagattttgtttcccctttaatcctctaataaccctatggaataggtactggcatcatttttatagatgaagaaactgacgctctgagaggttagtgaatttttcccaaaccacactacttgttcagtagcaaagccagaattccagtccaagttggtctgcctccagagtctgtgacctctctgcttcagtcctttaaagggaaggggttcatgtgctgtgtttctggaagggcaaggaaaaggtaaagttgggagatgatgtcccgcgaggcagccagttctgaaaaaagggaactctgtaagctgaagagggtggtaactagagaggaaagggaccaggcctctagctaggaaagtgagaacacaaaaattggtatggaagtcacccaacagaggctcaagaaggaatctgaaatcccaggagtagccagagtgactgtcaccataaggcaactcatacatgtgcagacacacacacacacacacacacacacacacacacacacacacatgcacagaggggaggactgttctttgacacgggccaccccatcagtcattttgagcaggtgacatctacttacagagacactgggggcggggacggtcccatgtgccatctccctggcagctgagcactggggtgcccaggaggtagaagccgtggttgcaccggtaagacacagtggtgccgaagctgaacctgtgcgggccgctggcgtggacctgacgaacactattttcttggtgtccaggatctgtacagttgatgactgcaattgaacagaagtccaaacaggcatggattcccagtatagtaaaatcttccgagcaaaactaggcaatgaagcagaccctgtcgggagggtgagctggtcccaaggttgctggacttctcccctcaccttggttacctggtcagaagagtcatccttccatgtccagctagacatcacctccttagagaactcctcccacctcttcccagattgattactctctttctggtactcccttgcacaaatcgctattgctgactttaccagcctgtgctgtgacttgtttgaacacacgagtcccttgagggcatgaatgtctagtctccatatatctgatcgtagcacaatgtgcctcccacagcaaagcttgtcaattgtaaaactgacgcatttgaactgacttgaacagggttgggctcttttgaaaatggttttaatcacttttatgagtatttcagggacatattaatatcctgggggatatatttgactttaaaatcttaaaagtgtttccaaagcagcttaactcaaaatcaggataagattttagaataatgacaacattattcataacccatgactatacttttctttccaaacatcttcaaatccattatcttacctgagtctcaaacttatcatatgaagtgggcaggaaggtattttttaaaaatctttgataagcctttaaggatttttacttttgatgaggctctctgaggcttcactgctgtcaaaagcctctaaaagcgttagaagctatttcctaaatactccaaatagagccaggacattctgtattctctctgccttttgagtctttggcttcctctctgtgtgttttcccccagccctcaccccctttatctcaactcttaggctctctgctttttaaccctctgctttttcatcaagaatggggatctcttaagagtggttccaaaggagctgcagcagccattttgcaaccacaaggaaagaccaagatattgctcctgatctcgtggagcagctgcagaaataatattacttctagatctcttgtttatgtgagaaaaataaacctctgttaaaaaataacggggctttataagataatgatacattatttgttcaatgaaaggtaaaaaagacgacttgaaagataaaacttaagttttgctttccttatataacccatgatgatgaaattttatgtggctctttatctaagggttgagaaagtcctcatttatgacccttctctgctccatcttccctatctggatcagaatgatgccagaatgaattcactggcttctttttctgagctacagaaccacatatagcagagatggtggggactggattgggagagaaagggtgactcacttctgcaggtgggcagcatgtcactccattgcccgctggccaggcattgggacctagcagccccctcagccatatacccagggttgcaaacaaacttgaccacatcgttgaggttaaactggttaccctgagtgaggccgttgacagggttgcctgggtgtccacaggtaattgctgtaaccaaaacagaagataggtaagccctcctactattccacacccctcagaatttatccacctctcacctggcatctcttaggccatcagtgaagttcagccctaagtctaacttcaatctcttttgctgtaaaacctttataaactgaaattgtcaggggaacattctgtctgccttgaagatatgtctgtagcttggacaacttgagatcaatcattctatgacttcccatagggtgttaggactggactgtggttctctgtggtctgagcggtcagtgctatcttactttccttgcctctgatgccctcggctccccagatccattcttaattgctgggtatactgatggccaactgtcagctggtttaggcccatcctcattcctgagccaaccttgtagaaccagagtgaatactaaccaagactggtgcagagttcagtcactctgctagatcaatagcccaggtaaactggggaagcagagctgctgtttggagagaacccactacctccaattccttccatggcaagggagttcagttagtgcactttgatctgtgcaacttgggagtaatgagctggcatgtttggctcagcatcccttctttttctagggacctagttgtctgcagggagcaatgttctcggctgctctcagctgttgaggagggaggctatccccaacattgcagggctgcatgccccactgcagtgttgcctctgtgggtgggtgaatccatctcattctgggttcatgtagcagcctccatctgactgtcacattaagctccattttccaacttagcctttattagtaagcgaggtaatatttgggcctccacctaccagtctgttttactattttgttcagacatgagcagggaagagaaaagggatgtggtatttgcaggccaccatgcttatccctgcatccctctgattccccctttctcccagtggtatagctcactctatttggctgcactggcctcttggaggtttcatgaatatacaaagcaagttcctgcctcagggcctttgcacttgcttttttctctacttaggacattgttcctgcagatatcccttaactcctgccctcttcttctcaggtctctcctcaaattaaccatgtcagtgaggccttcccttagtccctagttggccagcatggccagtactgccaggtcccttgctctgctcaacctctctccatagcactgtcagcaaccaacacaccacagcacttctgtatttgtttattgcttatcacccttcagctgaatgcaagctccttgaggtcagggacttggttttgcttattgctgcatccttggtgtatgtaccagtgcctgacattcagcaggagtgtgataaatatttgctgagtgaatcagcgaatgagtaagtgcatgaatggatggatgcctaggcttctgctttgatccttagtccttagttctatttcgtcccagcctggcaccctggtctcatggagttgaactcccacctgatgcttttgccaggcctctcgctttgttctgggttttaatttgtgggaagattaggaactataagggatgttctctttgtccaatacttaaatccatgaggatcccacctaagacccaaatggtgataatggggacgggggtgtaagaagaggaagcacccagtccttggtgtggccagatctggtgttttctgggctagttctcttctgtaaatctcagtagtagcaaccctgactccagtggagggagccaggaagagcaggggacatgctgttagtggaccacaggggttcaaagcagcctggcatagtgagatgagaatgagctatgaaggccagcagaccaggatttcggctcagctctgccccttcctgactttgggtctaaggataattcactttgagccttggtttctatagctgcaaagtaagaattttgatatgcatttcacagggttgctttgaaaatagattcaattcacataattatttataatcaaatgtctactgagtgccttttatgagctaggtactctgctatggagtggaatatacaaagaagaatataaaatgttctctgacctcaggaagctcattttacagacttgtaggagggcaggcagggaagcggctgttaaacccagtgggctggtgctgagatagagcccagcgcagtggaccgtggcttttaccctcctctggggagagagtgggtcaaagagggtcccacagggagtggcatgaggtctgatctaggtctcaagggtgagtagggcttcgccaggtcaagaaggtggtgggagagcagggataagcatcgcagcatctgtaaacccctgaaattatatgcaaggcactgggtgtttgcagccagctcgggagagggtccattactttcaccggatttggaaaaggtcgtgatgccccttccctgaaggcggaaatcactcatataaagagagagaagaatgttgaggattaaaacccttgggaataccactttttgaagggcagatgttaaaaaagaaaaaacctataggaaactgaggagtgatcaaaaaagtagtaaagcaaaaagctctacaggagggggtagttgtcacagagccaagagcctcaagaattgtcagatatccctgatagatcaaataagataaagatgaaaatgtgttcatcggattcatcaataggaccactggtgacttgcaagtgtcccctgcctggttcaggctcttacccactgcttcccacatattcccaagccacaggccctggaccaggatcagcaggagaagaagctgctgcgaccaggtgtcatctctggtgcccccatataagttcttcttgctctctttaggtcccaggctttctggctgcttggaagctttggctggcacttctcagattcctgctctgcagctcttgggtagcagaggctctgagcattctagaacatggcctaggaccagagatactgttgactgggatggaagttctttctggctagagcagagaagtggcctttgctgctaatgagaggggagaggtggaggcaattagtgtaggcaaccgtctcaagcagcatggccatgtgatggttaacttcacgtgtcagcttggttaggccgtgatacctagacatatggccaaacattagtccacattattctagatgtttctgtgaaggggtatgttttagatgagataacatttcaatcaggaggctttgagtgaaatagattatgaggccctccataatgtgggtgggcctcatccaatcagttgaaggccttgagagaaaaggcagcctgctatccctggaagaagagggaattcggctagcagcctgccttcagacttgaactgtgattctttcctgggtctctaccctgccagcctatgctggtgattttggacttgccagcctccacaattgtgtgagccagttccttaaaataaattgcactctctctctatacacacctcctatttgttctgtttctctggaggactctgaactaatacaggctgccatgggcagaagaataaggcatcattaggaggaaagtagaggtcctgatgaggcttgagcacttaatgggcttttgagcacatttcaggacaactagacctagtttcctaagggcagagatgatgtatgacacattcaattcatgttgatcctcagcacctaacacagggtctggcatatagtagatgctaagggaatctttattgaatatggtcttagaagctgagggaaacagaaagggaaggtccatggtaacataggagaggattaagaatagactaacctcactaaggaggcaggagggaaggagatccagagactggtggagggattaaccatgggctgggagagagattcttctactgaggtgggagagaaggggcaaggatggatgtacacagagcagatgtgtgggtggggaagctgaaagtaggagaagctattttctgatggcttctatcatctctgcagaatagaaagtgatattatatgattagctaacaattgttggggctcgcagtcattgtctcacttaatcctcacaaccctatgaggtaggcaccaccactatacccacagaaaacagaatttcagaggactcaagatatttgttcaagggtcacagtttctaaatgtctcatctgaattttgaacccagcttctctgattccaggccatcttaactgtttaacttagttatttgctgagaacgtaggtaggggcgatggaatataagtcttcagaaaggaggcagaattgtcaaacagctgtatggagaaagggcaagggaactgactgaggaaatgaagaggacagctggaaaattttgagagtctggttgacattggaaaccttgactttgtatgtactggcagctaacacagtgcttagcacagagtaaacacttacaaatatttgttcttttattcttgctttcctcctccagataattcccaaacctctgtgctccaagagagaatgggccttagtgtaagagatcctggattctgtaatgtgatggtggcagcattactaccaccactaccatcatcttcatcatcatcatcatcacacaacagcagcagcagcagcagcaactgctgcttaacatctggatcagacaccggtctaactatcttatgtgtattaatttatttaatgctcccagtagtctttgaggtgcctgctttttacaggtgacaagactgagacctaatgaggtaaatcgacctacctagagttacatagccacagcagatctgatggtagagctgagatgtaaacccaggcaatctgggtccacacctgagtgcctaactacttcactcactgcctttgaatatggtccagtctaacgttcaatgtctttaggccaggcagacattctccacccagaccccgacagtctctattatttattacctaaatctctttgtatacatcgtgcaccaatttcctgagggcatctgcatgttcttctgggtgaaactaaacatgttttatttagacacatctgaaagagtgactgaatacagatggaactttattttttattatttttgagatgggatctcattatgttgcccaggcttgtttcaaattcccaggctcaatggatcctccgacctcagcctcctgaatagctgggactacaagcacaagctacaatatctggcttgggtcttgctttctgtaacccttaagaagttattaagactaatttcaggcattgttttttgagaagttctcattattttatggccccatcccatatataaaaagccaaaagaagaattaaaataaaaaaactgccttacaaaaattaagaaggaaaacttgcactttacataaaggctcactttagggaaatttaaaaagtgaagaattatccaaattacttccaggcagctaagcataacagtgattgcctaaatcaaaaaaatgcagattaaccagaagaataaataatagaaaacccaggcctgcagcctaactagaagccagagagtgctacaaactttaaattacatgtaagagaaatatacactaagcccaggcagagttacttctcatggttctgttgcaagcttttgtggagagcaagactgtatgagaaagagaagagaggagcaggtgaagggcttaacactgatctaaaatcactgccagaaggagaaaatccatctcatatatgaatatactgaaaacaaatcttggtatgtcaatgtacaaccacagaaaagggacataaaagtgtgtgtgattctccctcattgcttctggaagaaaagaaagtgacatcctctgagtgataaagggaataagaagcaatgatgggaaaacctggggttctgcaagacaaaagaaaaacacgcaaacaaacaaaaatgaaggacacacaacctcttccttaccacacacaaaaccttatattaaaaaaaataaataaacaaaacaaaggcaaacatccaagataatcaaaatgagataaagaagtaaaaacaatcagagagaaagactttgtaacactgacagaagagggtactactaaaccacactaaagccataaaatgaatagaagacatcaacctaaatgtatacgaagctactttaagaaaaaaatagaaaagaattcaagaatttcatctgatgaaaacctcctcaccaaaaacaaaacatgtgaagcgtaagaaaaatgtagcagcattctaaactgaactaaatattctcaaataagcatctggagatattttaaaaaccaccatgaaaatcagaaaatcaaaaactaaacagcacaaatggacaaaaggtggaagaatataaaagataactgattgtatgctttaaagagataaaagaaaaagacaaaaccatctgagaaatgaagactaaattataagaggcccaagaaagaatattctcaaatgataatttaataagagttactcaagaaagtcaggcaaaaaaccaagggaattaaaatgagataaagaggtgaaaataatgagagagaggctgagagagaagataggcaaagaagattcaacatacacataatcagagctgatgaagaagaaaaaaaaaacagtgggaaacaaagcaatatcagtgtttaaaaccataatccaagaaaagtctttggaaataaagaaagacctgaatctatatattcaaagacccatagaatacctaaggaaattgtcttggaataattaactctgaagcatgtcctagtaaaaatattagactttaggataaagggaaaaataatcaggaacctcaaaaaaaaaaaacaaccaaataacctataagaaaaatagaattaaactaatattataattccaaaagtcaaatacgtagaaacagagagcagaatggtggttaccatgggtggagaagtgggggaaatgggagacggcaaaattaagaccgaacatatcagtcatattaatatatgtgaatgagtttaactaaccaactaaaagaaaaagatggttaagttagcttataaggcaatttatactgcatacaagaatcacacctaagagaagcagaaggctaaaatagaatggtcaaaggtgcatcaggcaaaagaattaaagcaggggttgtaagcctaatatcaagcaaagtacaattctagctaaaaaatgttaaaagtgacaaaaaagtaatctttaaaggctaaaaaccacaatgtgcaatggagatactagttatgaatatctatgcaccaaataagacagcaaccatctttatagaacagaaactacaggaagtgcaaggaaaaacagaaacacactaataatagaaaactttaaacacatctctcagaataaaacagattgagtgggtgaaaagtaagaatgtaaaggacatagacaacataatcaatcagatatatctcatgaatatataaataaaacatgacatcctaatatcctttcttctcaagtgcacatgggacattcataacaactgaccaactattaggtcacaaagaaagcttcagtcaattccatgaagtagaaatattacatacaatgcaataaaattagaaatgaataacacaatgaaaaaaaagggccttccacctagaaacaaatccttctattaaaaattttctatgtaaaaggggaaatcaataccaaaattacagaatttctaataaataataaacatttattattagactctataggatacaattaaagcagtgatcagaggaaatttcatagtcttaagcacttatagcaataaaactcaatagaaatgaaagaatgaaaataaatgaattaaattcctactcaaaagctagaaaatgaacaaaaatgtaaaccaaaagaaatcacaaggaaggaaataataaaggtgaaaacagtgattaatgatgcagagaactgaaaacattagatcaacaatgctttcagttttgaaaaaaaaaatagcaatcatatatatatatatatatttaaaacaaacctctagctaatctaattaagagacagggagaaagtccatgttgaatctgagccccatgactagggagagtggatgacatacttacgcacacagaaaggggtcttgcccgaccagtgatgatcctgctggcagatgcgcacagacatgccgatcaggcggaagccagcattgcattggtacaccacactgccccggtagctgtagttctccccattgatgtgtccgttgacaatgggctcaggagtcccacagtgtccagctttggtgagggatggggaagagagtacatcgaagaggagcttatagaaaatggagtggagcttggtctgagtggctagagacagggatggtggggaaaaggaccaactatcccacaactcattacttttcccacctctccctgagagtagcaatctaggagtgacttcaggaaccctcagcatgacaaaaatagtgttgaggacttggcaccccaaatcccaaggttgtaccccaaatggccactcacttctgagcttcagtttctgtgtctctacacagatgtgtgcaaaatgatcagttacctcactgtccccaggatcatcccccactttttcttaccaaccagatacaaaaaagccttctataaaaaaacaaacaaacaaacaagaaacgcccccaaaaactcaaactcaggagcatcttttttttttttttttgagacaagatcttgctctgtctgccaggctggactgcagtggcacgatcttggctcactgcaatgtccacctcctaggttcaagggattctcctgccttagcctcccaagtagctgggactacaggcatccaccaccatacccagctaatttttgtatttttagtagagatggatttcaccatgttggccaggctggtctcgaactcctggcctcaaatgatccacccgcctttgcttcccaaagtgctgggattacaggcgtgagccaccacacctagcctgggcatcttgtttttcaccgagcatctgctgcatggagggcaccattgtctacattaaggcagtcaaaacctggctgtgttgaaacaactatgtaaaaacagatggtttggctaaattcatctttccttccttctccttgagtagcacctaggtgaattctttttattatatgggatttgggtagaatatattcctggcatttctaccagcttcctttggctctctgtggaaataacctgtgactgtgtccttaatgggcctgagacagtggcaagacagcactgttcaccccaggacagaccattcaatctatcctattaggtttatgtggctggggccctcttttagactccaggggtccaagaaaggtgtgagaggagacagaaccatagaaccagggagtggattagccatggaggaaatgataactttgtcctttggaagccaggttgttttatgtttctgtaatttgcttagtatatatgtatagatctatatgttgtgtgtaaaatttgctaatagataatataaaaggtattttaggtgtgttacaggaatgcgtctgcaaatttgccaaaaatggagactggggcttcactcattatacaaaggccaataggaagggattgtctttctaaccagaatgagaacccctcaaaagcttgtctctttagatctgaggttcttctccttcttttgggtggcccaggagaagctgttccagggttttagtcatgcctgatggccaatagttggtgtttggattaagcattttatgtcaataggtgaaatgatactgtttaaagactggatctcagctttggaaagatctaatctatctcaaggagaaaaactgggcaggataggcctgcagaggtcacttaccaaggcagcggacttcagagccactccagagcccattggccatgcactcacgcaccctggagcccaccagtgtgtatccggaattgcaggagaagatggctgttgccccgtagacagacagtgttccgatgcggtggccattggggggaatcgggagctctccacaggagatgactaaaatgatcacaagatgctcagtaagccagccccaagaggagggacatggctgcttctgcttagcaagaactgtgacaaaaataagacctgtttaaccttactctgctggaattcctgaccagaatatgggttgtgttgctgacttgtgtgatgtggcacctcaactggaggtgtctccagaagcccctgaaggttatttaaaatgcccggctccactgcaggtgcctgactcaccagctttgcagatagcgccctggcctgtgtatttttttaatcctcctcaggtggctgagatgtgcactgtggttaggaagagatggcgattctgtggtatgctcctgagtgccctgggcagacactgctaatcaatttccttgcccttcttttctgagcccagcagcctcacactctttgtcaacagagcactgctgagagcctctggctgatgtatgaggtgaggcctaatcgccaaggctgcactgaaatgtgagtggctgcattgtagtgaggctgccaaacgcttgggactactctgccacatatgtggttacatcccactgtgcagtctgcaccacagtgtgcaaagacaacagtgtcatgaatcacggacattggctttttttttttttttttttgagacggagtcttgcacagtcgtccaggctggagtgcagtggcacagtcttggctccctgcaacctctgcctcctaggttcaaacaattcttttgcctcagcctcccaagtagctgggattacaggtgggcaccaccatgctggctaattttttttttttttttttttagtagagacagggtttcaccatgtcggccaggctggtctcgaactcctgacctcaagtgatccacccacttcagcctctcaaatgctgggatctatgcccaacctggatcacaggcattggaagacaccatttctcctccttcccagtttcaaactcccacttctcactgaccacttccttctacctctttacaatcacttgcctcctctgtgacatctgcattggtcacataaatatgatgagcatatccctatcgtagtgcatgctgcgatgagctactcagagccccttttaggaccgagggacttatttccccagctgctggaaaacaacccttggctggcagcccttttcagattgctgtggttgaggagtcctcccacctaggaaggtcatgtcccattcctaggccagcctgcatccagtggctggtcagtgtggcagtataacagttcccttgctccaacttgtgacaattctgaagggccatccagagctccctggggggtgagctaaggctttcatggatactgcatcagagctcaattctccttctgcccagtcctgcttccttccctcctttcccttctgtaggtggtgttctcaagagcaccccctaataagcctctgtctcagagtgtcttcccagagattccgacctttgaaagtgtattaaagaaccaaagaaaaacaattgacaatggagaaggcaggcaggtttaggtgacctgtcgcctgtgctaccctcattcctcctatatacactcccatttcaggtcttatcgcaccacattatcatcacttctttatgtgtctgcctctccagtagactataaagtccttgtgggcaggaaccaaaatcttttatcttcaaacctctacagtgtctggcatatagtaagagcctaagaatattaaagaaatgaattagtgcatgctcatctggacaaaagcagcttttgataagatgagaagatgctaagaaatacttccttaaaggagtaaaggagtaggcattttcccagctcctgattctactagatgagagtttaaaaagcagtacactgcaatccctggtgatacccctttttcccccaccccagttcactccatgcatgagacagcttaggtaggagggaccctgctaaacttgcccaccctcccttcctgggcttacttcggcaggtgggcgtagagtccccgaggctccatttgccattggcctgacagcggatgaccctttggccagtatagtagtagccagggtcacagatgagcatcagctgggcctggaactgatactgtgtctcaaagataagcctccatcggccatgctccacgctgatgctactgacatcaggacaagtcacagctggggaaatgaggaaaagaaaggaggattaattacttgattaattctggaagaccttgtaagagcccagatctagggacttggagaccttaatgcaataatgaagaatccaggaatcttcagttctcaggcaggtttggtaaatgaacaggtgggttgggtgggggatgtggcaaactggggagtacagttctgctaaaaaattaaaaattaaaaaagggaaatagtactcagtcaaggttgactattgaatgtttgagttgcatttgattagattttcatttttcaagagaagacagaaatctggattttaatgtaaaatttcttgattttaaaagattgtggagtaattcaaaatttgttataaagcaccgtgtaggccaaaaaacaaaacaaaacaaaaacctctgtctttggatgggacatagtcgaggaggttgccattttgtgatctggcctaaaagttgttgtttttagagctttggaatcaagggacattcatgcaaactttctgacaggttttccatctaaaagggagtggaccaggccattcctaagttccatggtggtttgtggaaacatcttagggcacaatggttatcaatgctgagagcagtttcagcacctgcctcctcttctgaaatcctccaacctccatgtccatgtttttttttttttttccccctcattactttgcttttagctcactccttgcaggaatctttccagctgcctacctagcccttccttacacccgcctccattgcccgaggactcacggacacactgtggtgggacattgcggttgctccataggcctgtgtccagacactctgcagtggcctcagcgcctgcctggaggtggtagccttcactgcagctgtacatggccttggttcccactgtgtactccttgccaaacaccattccattcttgggggcctcaggaagcccacaggaaagagctagcaaaaggaaaacaatgtcatgagcatttgttttaagatggtattctgagaaactatttttatccttcctcccctcccaaggtccttttattagtaaaaactaattaaagggtaaagtatcataataaaaaagaaaatgggaggatcatcagcagaagagttttttcttctttttttttttaagtttggaagaaggaataaagatagaagtgcaaagaagctgtagctcaaaatatatgggagggagcctcagggtgaaaccagttctccgccatctgttcccacaaacacagtgtagacacattcaagtatctactctccaaacgaaagagagaattttcttttccactgaggggggatctctcttaggatgaattagggctgttatggtgggagttggcatcccagaggaaagctcttttaattctaggatttatggtctcttggcctaaaggctgccccattgcctactcaggtctgccacatactcaactcaacctctcactgataggagagactttgtggaccaagatatctgtatataaaaataacaaacgtaatccacatctcatagctggaaaaatcaacctggcccttacttttaaaatacgatcaaggatcattatacatgtgaagaaaatcagcagtgcgaacaagacaaaccaagataaagtttaaaataaatgtccccttaggaaacagagctaatttagaaaacagaagatacacaatctttaaacttctgatcagtagtatcttgagaaagtcaaggtgacatacggtactcataaaataaaatcagtgtgctctgaaggaaaaaaaaacaaacaaaaaaaaaacaaggacaaactctttgaaatgaaaaatatgattgccgaaataagcattataggattagagatgaaaagtaaatttctcagaatatagaaaaaaaagagaccgaaaatgagagaaaatgacagaaaacacggatcaatcctcaatacagaaggtccagcatccaactgttcagagctccaaaaagagagaacacaaaaagtggatgggatggaattatcatagatgaaaatttctcagagctgaagagagacacaagtcttcagatggaaagggagccaaaggaatgcaaagagaatccctcttagattcaccatcacggaattttgtgtatctaagaagtccagagacacacaggcattcctccaaattactagaaagagggaaaaaaaaatgacataactgtgaaggaacgagaatcaaactggcataagacttcccatcagcagtgagtgttcaaagataatggaacaaagctttaaacctctgaagaaaatgatttataaactagaattttacccagtcaactgaccaaacatgtgtgagggcaaaaagatagacactttcagacatgtaaagtctcagaaaatgcacctcttgtgaaccctttctgaggaatttacttaaggatataccccatgaaaaagagggtgaaaaccaggaaaggacaatatatgagatatgaaaaatgacagaactaactcaagaatacaaagaaaaggaatctcaaagggacaactcaggagagaaatgtttgcagcaacatggccaggattattattttataaggagtagggtcgacattatgtttataggaggaataggaattacttaggcaagagtagactgtttggtctttgaaagaaagtaatacttataaatcatccttgctctttgacagctcagggggtattacagatggaaagattaatccgtcaaagtacccactactgcctccatccactatcccctctggctactagtctagagctcagaactttttcgcttagagccagaataagcttgggcagagtcccattgagattgcctaacaagatgcttgatgctataagaatttccagaaccaataagaggcatcaggctggggctccattatgaatggaggagggtagactgttcagagggagagaagttggaataccaagatggaagaaggatctaagtgtgggactttccagaagaggaggatcaggaacacagaaggaatgagaaataagagagtgtttaaacatgagactcttaatgactaatcagaaaggctatgagctccttcagtggaactaggttagctaagctgtcatattacatcaactacctgcccagcttccttaaatcctttgggaagaaatacttggatctccactggtgtcttgcatggagagtcaatccagggagggcagtgaaggaagtgggcggcagccacttctcacaggccctggcctggccttgctcttgtagataactaaggggacagaagataatactccagcctgagatactaaaagcctgtgtctcatgatctccatgccaaaatgcagtccccaaaacccggtggtaagagggacacttcctgtgggtaggaggaggaggggatacaatcacaaagtatttgaggcttgtggtggaatgagatctctgagggagagagacacaggtgagagagtgggctggggaaggagagagaaggcattaggaggcatagagtctctaaaggaagagtggaaaagtcatggtttggaaacagcagtagagaagtggaataatgccaggcccttcctggcccagaattctgtgggaagtaggaggtgggtggagggggattaacaatccacttgaaagggccacagcatacgtgctctcagaggacagccatggtctccatggagggaggaagtgaagacagccagctgggtagggactgagggtgtacgcttgctggccacggaactaggattccagagaacacagtgggaggcttagaggaagggcatcagtgggaggcaaggggtgcagtggggagaagacatgcacagtagtatggggatgggtcaactgaagtctggtggaggcttaattttgggtggtgatgtaaggtaacagaaatgagaggcttagtaggttccaactggcgctccggaaaaaagacttgtccttgttaatgcagttagagacgcagagaccaaagccaaatgccatttgccatttgtggacagccagttcactgtgacctttgcttaggggtagagtagattattaatagcacattgtttttgttctttgagaaagcacaggcacaggcgagaaggttgtgaggattagagatgagagatgtcattaaaaagtacttcaccactactgggaaccaaaggaaaaatcaaatagcaatgtgatttcctgtttttgtctatgtagttggcaatgttttcttctttttttaaatgcagtgcctaacgttgagactgtgggagaaaagacagttctcacatgctgctatacatgaggacaaactttctgggaggcaatcagtatcgacagctgtcaatcgcatacgttatgatgcgagaatctcatttctgagaatttgccttaaggaaatatgtaatattcataaagatggaattataagtttatcgtcacaaagaatatagaaatccaaatgaccaacaagagaatgatacttaaatgaatgacaattttctcataatgctgtgcaactattgaaaataatggtgacgaagtataatattaacaatagagtccaggcgcggtggctcacacctgtaatcacagcactctgggagaccgaggtgggcggatcacctgaggtcagcagtttgagaccagccggaccaatatggtgaaaccctgtctctactaaaagtacaaaaattagccaggcatggtggcgggtgactgtaatcccagctactcgggaggctgagacaggagaattgcttgaacccaggaggcagaggttgcagtgagctgagatcatgccactggactccagcctgggcgacagagggagactctgtctcaaaaaatagtatatagttaaatatacttcctcaccatgattttcagtggttgcacagcattatgggaaacaaaatctataagagctttgtacacggatgatcctatttttataatcaatacataaaagaccaaaggaaatgtgctgaaatgttaacagtggtgatctcaggtttattgttcattttcactttttttcttttgcattatctaccgtttttttttttcttcttcagatttttagtttgaatgtatattacttgaagggaaaaaactgtcataaatcataaaatcataaatcataaaaggtaatgcatgcaaattgactgacacatttcaagtgtttgatcaacccacttgctctatgagccggaacccaagcatcccctctgctgggagccctccccagctggccaggaggaagcagatcctttctcacctctgggctcccacaacactgattatgctcctgacacgacacttccttcctctgccactttgcattgatgtgctcacatacccatctcccccatggatctcaaaacactgagattgctacgcactacagatcttgtaaatgcttgtggaaagaatgaaataattatcaaagaggaaacccacatttggaagtgactagtcctgggacaaacccaagatatgagttggatccgagctaccttgtgaccccctttccacctgcttctcaccttgacagagagggatggcttcgctccacaggtggtagccctgggggtgccgggtacagatggccatgctgtgtcccaccaggcggtagccggcgttgcagccaaagtggatggagcccccgggctgggtgctggtctggcctaggatgaagccatggagtggagccctgggcaggctgcagtaaggggctgaacaacaagatgaggttcagggaactggcaccagcaggaagacagacatggtctttcatgcaggcccctttccctttcgtctcccccccatccccttgtctttgccactgccacatcctctgctgttgaggaaagtctgaatggtggatattgaaaaacacccagtcaggttggtaaagccgaaacaaaacaacggaaacaaaacaaaacaaaacaaaaaaaaccagcttcatgaagcactgggtcccttttgcggtccaaaggtagatctggtgtatggctaagttcaggctctcaaatcccttcagctccgaaacagacttagaaagtagaacccaatggggttggttccagaaagctgcgactgcgggggtgtggactttgaccttagtgagggctgggctccagtcccgtttctgatctgaccagtttctgtaacttggggcaaatcacttcagctccaatttcctcgcctgtaaattgggactggtaatacccacctcacagatttttgggcaatttaagctgtatatgtagattgcgtacataaagcccccagcacagcatggggcactcactgttcaatgctcagtaagtggtcattgtccttctttgtgctgtgtgggggaatgtgctgagactgacctgtggcaacctgggacacacatttccctacagtgctcatttcccctccacatatggcttcaacttatttcattcatttattcaacaaatagacatcaagtatctattatcttccagatattgttctaagtgcttgcaatacaacagtgaagaaaacagaccaaaaccctggcctgggctcacgccagtaatcccagcactttgtgaggctgaggccagtggatcacttgaggccaggagttcaagaccaacctggccaaaatggtgaaacctcatctctactaacaatataaaaattggccaggcgtggtggtgcgtgcccgtagtcccagctactcgggaggctaaggcaggagaatcacttgaacccaggaggtggaggctgcagggagatgagctcatgccattgcactccagcgtgggtgacagagtgagactctgtctcaaaaaacaagcaaacaaaaaaaacaaaacaaaaaatcccagcctgaaaggactcacattataaagcctgccagggatcctcagggggagttctgtgaggccaggaaagagggatgaccaaaggagcaggcagataattctctttgtttgccctaggagtccctggtggggtcttccaggcagagatggataaggcaggatgcgcgtgtggggcccttacagccacccctggtgaggtccccggcctctttcttggtgatcatatccgtctgccggtgaaatggttgttttaaatagctgccttccaagccgaatttgtttccctactcctgctttgcccgctgtgtcctatgtgtgctgtatccacatggttacctccctcaggaacaagaatctcggttgtaaaatatacttagtcacagtgacagacgcaggtgcaaattacactcatctactcgatctgaattattaagtactaattgttgcgccatgtaattaactcactttctacgtggcatatgtattgtaattacaactgactcattatccccaaacacgttagaacatcaaggaaagggtaactccttaataacgttcagttcctaatttagcaaccagcatagtgaaatgctaccaaactgctatatttcctgtttgagtgagcagctgccaggaactcagccctaagaggcaccttaaagtttcttttccatcatgcggacactgaagcctgaagtggttaagtaccttgcctaataatcccacagctagtaggtgagagagctggtcactgacattggggcactcagtcattgcagccacccagacccctctccgtgtgcaccagggaaaggagaggttggatggactttgcagaggatatgggctctgagacagtcaagacccaccttctcccaggggccctcagcttcctctggttggctctcccctgaaagctacacccagggattctttaagactgtccacccactgagtatgggctggtcttgcaagtaggagacccatgagaagagatggactgtggcaagtgggacttcaggcactgaatttgacattccttccaaccaagattctttttttttaattttttttttttttgagacagagtttcactcttgttgcccaggctggagtgcagtagcgtgatctcggctcactgcaacctccacctcccaggttcaagtgattctcctgcctcagcctcccaagtagctgaaattacaggtgcatgccaccatgcctggctaatttttgtatttttagtagagatggggtttcactatgttggtcaggctggtctcaaactcctgacctcaggtgatctgcccgccttggcatcccaaagtgctgagattacaggcgtgagccactgcacctagcccccaaccaatattctttagaaatttgttcattgtttgcctggaatgtaggccaaaggtagccaggggaaagagtgctgaaagggaactggtgtgtgatggaaccccccatggtcttaagtaattcatttctgcctccaagcttgcggagcccagtcagcagttcactgaacccacctctcttcaaagtgggcatcaagcaccttgtgaagttttcttccaaccacagacagtaatccccatgacgagagatcagataaattcaattttctccatctcattatattcccaggattatttttttcagtccttatagattgttgcctgggtcagtctttggccttttgatctgactctgtttataagatatggcttgcagagcagaagaaaggcacctggccttgaaatatagcccatcctttgctgcatgcttaacatctgccagtcagagatctatgccttagggctttttagttttaagaaacttttattagcatttcctaactttcctaaagggacaggatcactgttaggcattatcagatcatataaaattgttaaacttatcctgaagacaaaggctggcagtatgagaaaagagggaagaggttcaagaggggaatggaatagaaaaataggaggtaggggaatggcaaagaccacttagcttcaggtgaggcagatttaggaggggaatggccgcccggtctccacagaggagcttgaggcttcgatgaggagagggcctgtggcttatttgtgtttttttcactcacctgaatagcggatcttgaagcccttccgattgtaggcgtgatcagatgaccaacgcaggtacacagagttgcttgagctggtgacaatcaggggagctgagtaattcccactgagggctttcagcagaggactctgtcctgatggacctggggtgagaaggacgcaggattacagaccatgggagccatcacagggagcctccagggaagacctcagggctcagagggtggggtgacttgttcagagtcagcaaaatcatttgtacttgcactcctctctctgcatccacaggcattgctcaaggtgctcttttctcctaagcccagctctaaagcagtgctctaggaagtccctgcctacctctaggggctggcaggtaagatgaaattgatttgcattttgagacttgacaaggtcaagtagctggttaatggaagagctggttttcaaactgggaacttcttccacttggccaccctacttctcttgtgtgtatttaagctcatgtctgtaatcccagcattttgggaaggtgaggcaggtggatcacttgagcccaggagtttgagaccagcttggcaagcaagaccccatctttactaaaaaaaaaaaaaaaaaaaaaaaaaaatacaaaaattatctggtcatggtggtgcatgcctgtagtcccagctactggggaggctaaggcacgagaatcgcttgaacccaggaggtggtgagccaagatcgcaccactgtgctccagcctgggtgacagagaaagactcagtctcaaaaaaaaaaaaaaaaaaaaaaaaagaaaagaaaaaaagctcagtgcctgccatatagaaaaaaatatttatggaatgaatacatagcaataaagctagaggaaaatgtcatgtctcggggtcataagtaacagagctccctaatactgcttttgaaagctctttgagaaagacctccctcttcttttgtcctaccttaaatgtctgagattgcatcccgagggggctggttgaaggggcgcagaatataaagctggataacccataacacaggatttatcactctggaaaaggccctgaatgatggctctactatgccactgagacagctcttagaagcttggaaaaattaatggatcatattaaacaaagtagagtcaccagaactgccatgcaaactgtgaagggaaaggctgggagaagtggcatgctgggctaggtctgctgtgtaaaagttgaccatagttctcaggaagacctggaggacactccatttactaaagcaatcaggaggtgaggagctccagccttcctggagcgggtgagcaccagcattgctgaaaacctgagtaactaatggctatcctctgtgggtcaaaactgatggggagagacactgggctccctagcagtaatggggatgagaaggtcctagaacacagaggccaggtggaattacttaacagtcagaagcaaagttggcataattactaaaatgggaagcaaggctggaatggcagctgggagagcctggcctacgggatctacgaagatggctcatagagcatgatgttcctaagggcaaggtaaataggaagccaagaagagcagccaaaacaagtataactatatgaacaaaacagatcattagtagctaactgcaggatgagaaaagctgcccccagcagaaaggtgcaatcctttgcccagtttgcagacttgagccaggtttcatttcccaagaggctgggtccctatgaaaaaagaccccgcacaatgacaataattgtatatagtagttgttcctaccgttcttcccccaaaagacctactactgtttactcagaaaacagaatattatagaaaatggaatgttcagatatatcaaagacttctggatacaggatgttaattgatgctgatgactgggggtccaaagcactatcatagctactctgccagaggagtggtgtatgaagggtggttttgggaataaatggagtcctggcccaggtccgtctcacagtacacacttaacaaagtaggagcctcaattgtagcagctgtgtgaggcgcatatctttattagaacagattaacacagccttggttacatagaatgtagctgttgatctggccatgtagtcttttccatacccttcagaaatgaggatcagaagcactttgcattcacatgaggtagacaacagtatacattcatggtttcccccagagctatgttacttctcctgctctctgtcataaccgagtataaagggatgtggaccatctggacatcttgcagaatataacatattggttcactctattgaggacatcatattaattagacctgatgagtgagaagggacaattagtgctttggcaagatgacttttcaagatgcatgtgctccagagggtaagaggtaaatcctacaaagttctgctatgaatttttagggtccagtggtctgaagcatgctgagacatgccctccaaattaaagagcaaattattgcacattttccctcttaaagccaaagaggcagcacaatgtttggtagatctctgggttttggaggaagcacactcttcacttgggaatactgtttgacccatttatctgctgacatgaacaggaatggctttgagtgggagctagagtaagaaaaggttcggtaacaggttcaagttgcagtacaagcagctctgctgcttgggccatgccacccctcaggtcccatggccttggggttgctgtggtagggaaggacatcctgtggagcttctggcaagccctgataggaaaactgcagcacagactcctcgggttctggagcaagtccatgtcttctgcagcagagaactgtgaggcatttgactgacttaccatcaaaaatctcaaactcatcatattgcttctcgctgaggaagtactccactgtgagggagatgttatagtcgggctccactctcaccagccaagagcaggtctggaactggggatagcttccagggtagctctggctcaggatcacgcctgtggagtctgtcagaagctcatttgttggacagtgcacttggagaaagaaagagaaacaccaagtacgtgggggtggagatggaactacggccaatacatttgcttttcccaatactaaagacaacccctagaaaatcagtatttgagcacattcagataagatcccacatccatcactgtgctgctccatgacatgaggtgggcttagatcctgtgtcaatattgcagtatttctgggacttgagctttgccagttggttggaatcacttcctagataagttgtgggttctactacctggctttgagtaggggaggatggaacatacatacagacaacagtaaggcttccccagatccaaaggagataatctataaaatgggttttatttgaacaaagattgtactgtatagggcagaggtaagtacatgggattttgagtcaaatacacctggattcatagcccacctctgccacttactaatggtgtggtcttgaacaagttatctcctctctgtgtgatggcttctctatctccaacacagagataacacagaccttacagggctgttgtgagcattatataaaatattacatgctgggtgcggaggctcatgcctgtaatcccagcgctgtgggaggccggggcgggtgaatcatgaggtcaagaactcaagaccatcctggccaacatggtgaagccccatttctactaaaaatacaaaaattagctgggtgtggtggcatgtgcctgtagtcccagctactcaggaggctgaggcaggagaattgcttcccaggaggcggaggttgcagtgagctgagattgcaccactgccctccagcctggcgacagagtgagactccatctcaaaaaaaatatatctatatacatatatgtatatatatatattatgaaataatatatgtaaagcatgcaacatagtgcttcaataaattgtagagggaatgatgaaaactgcatcttgaacagaaaggtctcagaacttggctgtggcttaattagtactatttatatagctaaagaaaaaaatgtcattctaaggaagacattgagcttggaacttagaaaaggaggagctggaggagcaggattcgttatttcgtcatcaccatgagtgggagggaagctgctggttcagagaggcccttccccagcactgaggagatgctgtgtcctggggcacaggcaagcatcacagcatgaaagcaatttcaggaccatccacctccatttgtttgggttgcggacgccaaagcaaagttctgaggactaaatcaacttcttcagtacattgttctttcagtacaaaggtgtgcattgacaatagttgtaagtattcttatcactgcacacggagaaatcagtgttttgcagtagatgtgcctttagacaggcttcctgggtctgctggattctgggacactgctaaaagggaggttctggaacgggaactgcaagaccaaaaattaatcccaggattacaatttcaggtaatgctattttgggtacaagactttgccatgggctgttcacccatctcacctctgccttcagagaagtggggcttggtaatcagcacgggggctgggctcctagagtcttgctgtggcccagaatttcacaggacgcatccaggattctgcctgagtagctttgaaaggtactcactgacttttcccaatagagcttcctttttaattttaagaggagaaggaaaactaatgtcttctaagaggaaactcgcttagctttgacatgttcctgatttcactaatccgatgaccagcacagggcactgagatgtggtgatacttaagttctctcaggcctcgtggtcctctcctgcctctaccaggtctgctattccttactgacagtccatattgcaggttcttcctactcttgctttcccagaagtgggggaaaggctgacctgtttccccataggctactgaatatttgcaggtagcagtagttctagaaacagtagtcgcactaatgataatattaacacaaatatggagcaattactgcatgccaggcatcattctaaactggtttatgttattaacccatttaataccgccatggcataagtactatcattatcctcagtttatagaagggaaggctgagggcaggacaatcaggtaccttgccttaggtcagatgcctgatgagtggagactattttttgatcttaattggggtgactcgctgaagcgaattcatttctgtcaaggcatggtacactggaataaagactgctgtggtctctcagttgcctggtttggcacacagcaccttgagtgcatccgcgcatcagtaaagcagggatggtgtgtgagcccacgcccacaccagggagggacttcctccttccagtactcagtatgcaattccaagaaattcccaggaatgaaaaaaaggcagatgaaaataaatgtggccactgtggccaattcacaggttcagatatcagaacagggcagagaacctatctagagtgatcactcactcattcctcatgcacttactcatccatcagacaacatttaccaagtgacctttcatgttatggggcagtgactgagctgagaactgggaatagaaagaggagcaaaacaagagctttgttcaggaggaacttctaggccccatacagatgcggctccatgcaattaccttcacatatcgggggtggtccttcaaactgcaggtaggttccaagtttgcaggtcagaatttcattccccactaaggtaaagccagggaggcatctgtagcgtacgatgtcacctgtcaaagaaagaccaacatgtagaccctcttaagaagtccagtcattagtaccttgaacccacttccaggtgagataatcagaggcgggtcatgttctgttcagacttaaataactagctcagctcccatcaaatggcccagacgactgctcccctctcacaactcagccttgtgtgagcctcagaatgtttcatattccaggacattttatactgtcttgcatggatttatttctcaaaaagatgctgacttgaaccaaaaaaagaaaactatttttctgcctccccttttgattttattttgggtgtaaactcagtgggcagaaccctctggcacagggcctactgtttctctctccacagacaggagcaggggataaggtccactggcccgacagctccccccgccaccttcccttccttccccagtcctgggttcacagtccttgctggcttgggaggtggtacctatattgaattcttcattctctgtgacgacttcggcgttggggaggatggtgggaggagggcatttggtgagtggataagctgaaaagataaaagcaggcaagtcagggtaagatcatcattctccaggtacaccgtcattcatttgttcaattcttcactttctcatccctcatttattcacacacagatattcatgagtacttatctgtaaacagggcaagtttagccaagtcctttttgcttatcttctgtcatccttattgaaattaataataacaaaagaggggcaatctaaggagtcagtgacaccatcaccagcactgaagggtgggagaggagcgttttctgagtgcctcgtggatattaggcgttttataggctgccactctaaccctcacaacatctgaccatgctgtgaggtgctcttactctactcgtgagcaagtgagattcagaaaggtgaagtaagttcctcaaggtcacacaggaattaggtggcacaggtaggatttgaatgcaggtctggctgttcccaaaccctgtattcttcccaccactgagcatctacatgctgcatgtggcttttgcgagtacctactgaagtcagctgacaagctgacccttctgatctttgaccagatacttctggattcacaaattttctaggctggaattcatccctatgggcagagactggatgatgctagaggcaggatgctatttactgaggctaagttcagtgtgggctcataacctggcttttattactaacacagagtcaagtgctatacaagtgttagctgctcctgctgccactgctgctgttatcgttactatttccaatcaccccaatccttgctatattaaaaaagtgttctttaataaatacaaatatagtacattatcattaaagaaaatttgaggtattctatggaacagtaggaagaaatcaaacttatccattgccctctcagagataacgactgttaaccaattacagtacgttcctggagtgtttattctctgcaaatataaatatttttgttttatacaacttgcattatatgttatatagcttgtgttgatccttgcacacttattattatattgcaagaatttcccatataattacatttcttagaaaatatgattgaaataacttcataggatttaatcatacagatttactagaatgtatttaacagatactctgttaaccatttaggtttccaaagttttgcaatttaaaataaagctgcaatgaaatctttttttatatatgcatcttttacgtttttttctttttcttttttaactaggaagattcaagtacatgacccttttgaaagtacagatatctcctgctgaatgtcagtaatcctttcctggaaatcaaatgttctgtgtaaagatattaactaggagcctatatcccattattttaagtgggaaaaaattatactgtgttgtacttcaacccaaaatccaaaaagtaattaagacaaaataaaatacctaaatatatgcaacaaaccattatgttagagaagttaaatacttaaaacatcacgatcacccaacaacatggtgtgacaaaacagcgcctctgtgcattgcatactgtaccatccacatccagtgcgccatgaaatcttgcagcttgagacattataaaactctaggcagaaagaaggtctagctatgaaagactcagtgggaatgcattcaggactggcactaggtggtagagtacagtttacaatgaacagcatggagtgacacctcagagccagcagcctctgagacacacatccccgccatggaattggagcccctttccaaaagtccgcatgggattctgacattttaccaactgtagttggaatgcagcttgagactttccctgcatatagatttattgaaaatggtgtactatgttttgggggatctaactgtaaatgttttctatagacgcactcgctgaaatgtatcgtactgagagatacgtaagctctatgaaatgtgggtgttaaaactaagaggcactcttgaggtaaccaagtgggtttacctttgatttaacataagcctgggaaggccacgtccacacttgctgcatgcttccactttgccctccaggaaaatggttcccattgatactgtcaacagagtgactgttcctccagcactgggtgccatcattcttctttcacccagttcatgtaatgattgtctatggagggctcaccctgggtcaggcactgtgtcaggtgatgaggttacaagaacaaccaaaacaaatacatcccttgccctcacagaacttaggccccactgggagagatagtcgtctgttttaatctttgttaacttgctaaacaaaaaagcagcatttattttattttaattggcatttgataactaattaggctaagcatttttcacgttaatggcctatttgcatttctctttttaactgtctattaaaagagttgtgatgaaccaatatgttagaagtttaaatacttaaaacatcacttcatgatcacccaacaatatggcgtgacaaaacagtgcctctgtgcattgcatactgtaccatccacatccagtgcacggtgaaaccccgcagcttgacacattataaaactctaggcagaaagaaggtctagctatgaaagactttctttgcccctatttttcttataaatttgaagaactctgaatattcaaggttgaccttagccgttaattatattttcccagtttatcatttgcttagttttatttatggcacttttgatttgtagaagtattaagtttttatgtagccaattataatttttcttaataagttaaaaaaattggtgccttccattctcagtgtcatacttatcttcaaaacttctaaggcatactaaacttttccaggaaaaaaaaatgaataaaaacaaatccccacttaaatacagcctgggtactttatattttgtgattactgttttgattggggtgattttccattacattttaaaactaggttttttttttttcagggtcttgctctgtcacccagactggagtacagtggcacaatcatggttcactgcagccttgacctcctgggcttaagctatcctctcacctctgcctcccaagtagctgggactacagactcatgccaccacacctggctaattaaaattttttttttttttttttttttttgtagagatcgggtttcaagatattgctcaggctggtctcaaactcctgggctcaagtgatcctcccaccttgacctcccaaagtgctgggattacaggtgtgagtcactgtgcctggccataaaattacaaatttctgtttaatgcgggaagctcatgggatactaaaaagcaacaaaacaaaaatttcccaaatctcaccatctaggcataagcattgtgaagattttgctgtaggatcttgggtcttttacagacacgccctccctatttcccatcacacacacacacacacacacacacacacacacacacacatatactcttaccacattgatggtatcccactgtatccaccatgttattgctacagaactctagggcaggggacattcaaggcagactcttccatttcattttgtgaatacccttcttcttcccctgaggggaagagggtgaggtgttgagagagcatagccagattctggtgtgtgtgaacatgttaactcgtgaacggtgggggcaattgctttattaatgttaagcagcagttggctcagcagcagccattgtgagcaatggtccctgtcgtcttcctgggaatgttattcctcaagctgctgggtgtgctgaattggcctttcatttgaagcttttatttatcttttttttttttttttttttttttgagatggagttttgctcttgttgcccaggctggatcacaatggtgcgatctcggctcatggcaacctccacctcctggtttcaagtgattctcctgcctcaccctcccgagtagctgggattacaggcatgcgccaccacgtctggctaattttgtatttttaatagagacggggtttctccatgttggtcaggctggtctagaactgccaacctcaggtgatccgcccaccttggcctcccaaagtgctgggattataggcgtgagccaccatgctcggcctcatttgcagcctttaaaaccaaattagcttagaaaaaaatgtgagctcacatggttcatttgagcttaccaaaggactcaggctctgcttttgaatctggggtccatgcccagctaatattgaaatgccttcctttgcctttgtttcttgtctgtatctctttttcagaacatcacaaggagtggtgagtgtggtctagggtgggagtccataatcactgcattttcttgtgataccatcacctgagtttttaaaatcacctgctttttttgcactgaacaatataaaataaacattttcctaaatcagtgaattgtattctacatgagtgattctttttattttctttttagagacaggttctcattctgtcacccaggctggagtgcagtaccacaatcatagctctcactgtaacctcaaactcttgggctcaactgatcctcccacattaaccttctgagtatctgggactacaggcatgcaccaccacacccagctaatttttttttttttttggtagaggcagagtctcactatgttgcccaggttcatacatgaatgatttgtaatgactgtatctttccctatctctctctctctgagtatacactttaaatttataatacctaatctcttactatttttacatttagattatttctaatttccctgttataacatatcaagcaatatcttcatgcacatatctttgcataattcccagaagtaggattgctgggtcctaggttgttgtattccttgggaacctttggatgtaaataaatcaattcaggctagaataagcaaaaaagcctctcagagaagagagaacccaagggtgggtttgcagccagacttcacaaaggtagaggacgaggaactgaagggccatcagaaaccaaggaaatttttccacttctcaatcattctctttctgcacataggattgttctactttttggtccacatggaaagtagaagagcagcaatccattgcacttggatttttatcttttcaggagatgggtccaggcaaaagtagaatctcttgggtcctatttcaacttcccaagagagaacatctgattgcccctgctgcagtcagctcaggtgtccacctctggtccaagcttctgtggctggggggcagatgtgtgcgtggaggggtgtcacaatgtacaaacagctgccaagtgccctgaggagcagttaaagagaacattatgagtggcacaggcaccacaaagtgattggaatgtgtagctaatcatattgtgttaaggttttggatctgcaattctcaaactacctatcactaagtgggcatctttctgcaaccttcctaattggataatcactttaaaaattatcatgacggccgggcgcggtggctcacacctataatcccagcagttttggaggccgaggtgggcggatcacaaggtcaggatatcgagaccatcctggctaacacggtgaaaccccgtctctactgaatgtacaaaaaattagctgggcgaggtggtgggtgcctgtagtcccagctactcgggaggctgaggcaggagaatggtgccaacctgggaggcggagcttgcagtgaaccaagatcacgccactgcactccagcctgggcaacagagcaagactctgtctcaaaaaaaaaaaaaaaattatcatgacatatgtgtacactcatgatcttagcagcattattcacaaaagctaaaaggtagaagccacacaaatgtccatagagggatgaacagataaacaaaatgtggtctgtactaacgttattaataaatatataccacatgtgtggaatgttattcagccttaaaaaggaaggaaactctgacacatgctataacatggaaccttgaagacattatgaattctgcatttttctttgattgttactgttgttgtttatgtttgcccaatataatctctggccacccttttatctttaaactgtgtcacattgtcttagttatgttcctggtatagaaaatatagttgaatgttatttaggttaatctaaatatattagtccattttcatgctgctgataaaaacaaacctgagactgggcaatttacaaaagaaagaggtttattggacttacaattccacgtggctggggaggcctcataatcatggtggaagttgaaaggcatgtctcacatggtggcagacaagacaagacagagcttgtgcagggaaactcccattttttaaaaccatcagatcttgtgagacttactgactatcatgagactagcacaggaaagacccacccccataattcaggttcttcccacaacatgggaattgtgggagttacaattcaagatgagatttgggtggagatacagccaaaccagatcattaagagtctttgttttttaacaggaaattgaattttagtaaatttgcatttttcattacaattgaatgattttattctactgctgtatcttattttgtgcttgctgtatctttgtccctacatagtttcctttgttctctgccttttatatttggattatgttttacatgttttttcttttagtgatttagaagtactatactttattttaaatatattagtgactaaagtatatgttcaaaatccttatttctctagtgatcaaagtcaacaattggataatatatattgattccaccgtcacaaaagataaggacattctcttatcccttttccaccttcttgcacatttattaatataaaataattatttgtagtcttttaagaattattgtatttgcactgctttgaatccatatgttccattattatttagctttaagtctgtgcttaactagtatcaacactccatttttatcttttctttcatacatcttctctattttgagttactggttcatctggagttcatccggagttacagccacctggagttacagccccgcttgagatagagtggcaataattgtaaattcttgaatccctgcaaataacaatttcttgcattcacacatgaagcccctaactttttctcctccttaaacatcacctccttcattttctgtaatctaacgtcaaaaattagcctgagaattgtctgattttggttcatttaaggtaactttctcagcctggattcttgtagatttcccctactcctcacccttacaagttgaaaaaattgccagcctcttttttatttctcttggtatccagagagctcctttatatacacaggttttctttcatctcagaaaagttttatcatttccatttggttcctttcttcctgaatgcttgttatcagtgtcttggctctttgtccactgggtctccttatttcttatcttctatcttctctctaccattttcacgcctctgcccttctccctatttgggttgagattttcaggtttgtcctcctcatctttgcattgtttttctacagtgttgcttctgctctcgctgattcttgtgatgatgaaaattacgctattttgtttcttttcagtcttgctattttttagtatctagcttcccttggaaataaaagttttaatttggagcagccacaaaggtataggagaagttggaagtatagtacaaaaatctttttccatgaaccgtttgcaagtaagtcgccaacatgttgccctgtaaccccagaatatcttagtgtatttcctacaaactagcacattctctcacataaccacaaaacaaccatcaacattgggaaattaacactgacacattactgccatcgaatcttcacatctcattcaagtttcacctgtttttccgataaattccttgataatttattgatccagttcagaatcacatgttgcatttcattgtcatgtctctttggtctcctttagtctggaatggttccagtgtctttacttgaccttcagaacttttatatttttgaagactgcctgccagggagttgacagtccgtccctcaagttaggtttgcctggtgtttcctcctgattatgttcagcttgtcttctgcaactggataatcatggaagtgatgctggcttcttctcactgcatcctctcacctggagtatgatttcaatttgtcccattattgatgaggtgggcgtgtcttccagtcttctccacttctttttccctttgttattattgtgtgtggagtggggtgggggaaggggtagtttgaagttatgtaaatatccccttccttataaaaacttgtaattatttaatgtctgcgtggatatacatagtgttctgtttgattcaataggtcaccaccatttgttactattttaaacaactttgattctcaaattatccccaatatggtcaatgagaacccctccaagccagattctatgtccctttgacatgtctccatcatgccttgggcatttccttagtttctgccataagatattcctggcttgtcttctactttctctgccccaggcttgggattagccatttcttcaaggagccctggtccattttagtggaaaatgttatttaggaaccaatatctggtgctagatgtgctcattactattgaagaatcactgctctgaagccttctcagtagaaagagctaagaaatgtatgtgcaaacacacatgtactcaaacatgccccactcacacactattttcttccatatctctacatattgaaaaccataagctcacactgatacatccaattcaaatttaacaccattgggtatattataatttttgctctatccatagttctaaccctcttctctgacagtgagacacctgccttctattgtccttgacgtattaacgtattcgatcagtcacccatctggaaccaaggtttcatttctgctgacccctccctcctcaccctacttgggctctgacttcctttcctgggctgaaccttctctgtgtggctgtccgccttcctctgcttgggctccaataccctacatgggtgtctgctcatcctgcgcagagctctgacaccctgtgccagctccatccctgtacagatacctaagctccagctgcccatgccaggcagcccatcagtgtggctccccctgacaccccggcctgggctacaatggttcacactccctcttgcctgacaggtatggatgctgtattagtctgttctcacactgctaataaaaacatacctgagattgggtattttataaaggaaagaggtttagttgactcacagttcagcatggctggggaggccttaggaaatttacaatcatgggagaaggggaagcaaacacgtctttcttcacatggcagcaagaaggagaagaatgagagcccagtgaagagggaagccccttataaaaccaccagatctcgtgagaactaactcactatcatgagaacaggatggaggaaactggcccccatgattcaattatctccacctggtccctcccatgacatatggggattatgggaactacaattcaagatgagatttgggtggggacacagccaaaccatatcagatgtctttgctttgtcccatctcacagctttaggactgaattattcaagtggggaagggaagagatttagctttcgttttatttatctcttggccagatctttcttttcatttgtgtgctgtctgaacatttcacctgttatttggagtccatgttatctagacttatattagaagaagatgcttcccaaaatttatttctattacttctagttcctaaaccatgtttttttttcaagggcatttttctctgtaattcaaacttcatgttctaacttttaatgttataaaatctttcacaggtctccttaaggtatttttcctttttcttattgatcctcatatgaaaagaaagttccttagggctgcttgcctggagaaaggcaaaaattctttcccccactcccttccactgtccactttttgcaagtctagctcctttttttttctttagttcttatcttgaatatcctctcttaggttttccacaattactttgcatggaattctacaactttttgtttgctatcttatccttttatgtctttcgaagcatttgttacaatttgcaaaaattttgtcctcttggttactcattatctctttctccttggagcaggaaagctgtctggggagcagacatttcacagagcaggaagcatgaacactcagtaacacaggaaaggatgctctgcctcatcacaagcatacaagtgaaatgccatctcatgcacctaccagactggtagaaatgtaaagtctgctaaaacccagtgtttgcaaggatgtacagcaaaaggaactctacttcagttgctgggaagagtgtaaatggttataactgcttctaagataaattgagcattacctagtgaaactaaatatgtggatatttacaacctcacaactccacacagacatgtactcaagagaaacccttgtacatgttcacaataaggaataagcaacaatgttcttattgcttgaaatgaaacaacttaagtgttaacagtagactaaataaattgctatattttcatgcaatgaaatcatacagcattgaaaaatgagttaagtgcagtcacgtgcatcaacatgaatttcaaaaacttaattttgagtgagaagagcaggtcacagaagaacatttatagaatgattgtctttacataacagaaataacatgcaaaattaaacaacatatttttggagactcacatatggagtaaaataaaaagaaaagcaatgaatattaaccaaaagtacaggatcatggttaactctcagggtagggtaggggaatgtgctgaggaaggaacagagcttcaaaggcttaggtgttctttttcttaggctcaatgatggtgttcattttattactctttaaactgcacatacatgttacatacatttttatatgtaggatatattccacaacttaccaaaagttctatgaggcatggaatgtgcctctcttgctcactcatcccctagtccagtgcctctcccacttgagcctgccgatctgggcacagcagttcctcctctcttgccccagacccttgcctgctcctgtggtcagtgaagccttgggctctggtctgagctgggactgaatggctgtcttaatccattcaggctgctgtaacaaattaccatagactgggtgacttctaaacaacagaaatttatttatcacagttctagaggctgggaagtccaagttcaagggactggcaattttgatgtctggtatgggccttcttactggttcatggacagctgtctttatgctgtgtcctcatgtggtaaaagcagcaaatgagtttcctgtgtttttttttttttttttttttttgagatggagtttcacacttgttgcccaggctggagtgcaatggcgtgatcttggctcactgcaacctccgcctcccaggttcaaccgattcttctgcctcagcctcctgagtagctgggattacaggcatgcgccaccacgcccatctaattttgtatttttagtagagacagggtttctccatgttggtcaggctggtcttgaactcctcacctcaggcgatccgcccacctcggcctctgtgtttcctgtgcttcttagctctttccactgagaaggcttcagtgtggtgattctgtgggtctcttttataaaggcactaatcccattcatgagggctctgttgtctgacctaattgcctcccaaggccccacctcctaataccatcaccttgggggttaggatgtcagcatatgaattctaggggggcctaagcatttacaccatagcaagggccttgtgtctcatctgagaggcagaaggagcattgtgcccttaggcaagcactctcaatgaaagaccttgctgagaagaacttggaaataaggatggcctggggctgtgctgagcctcctttgcctggttctggtacaggtgaaggctcaggaacaggaacaagagacctggcctaccaccaaggtaactttacaccaagcctgtcaatatctagatataataaaaataatcatgacaatgatgactattagaactataatttattgatcaccttttatactctgtgcctggagctaaggatttccaagcattgtttcatttaactttaggaggttaggtacttatatgattcctattttgtgcataataacattgaggctcagaagggtgaaatgacagacaaagttacatagcttgcatgtgtcagagccaaggtttgaacccgtctgtgactctgaagtccatactcttatcactctatgggaaagtcacaagtcaaaatgacagagccttaaagcctggatttcattagtggagcgacaggtgtgcccaatgagaggggcatgggaactgagcagatggagagggcggagtctcattcccacattgcactcaccctggacgatagctcctgggaatggcagtcacagctgcttaggttctttacatccttgtttctctctgttgcttcctgtttctttcactacctctttcacagtcttagtgtgtttctgcaagtgcacgcatgatgtaataacactgtatagtcacaccagagcagatactgtagcagatactgcagcagatactgcggaggctgggttctgtttccagttctatccacatggttttgggcaagtacttgagccttcctttgccctatttcttcatttgtaaagtgggggttagaatatttgccttactacctcacagaattcttacaggtcacaaactccaagccggtaattctacaggtgaagaaactgaagtctcaagtggggaagggacctgtgcaaggttttacacagctggcccaaggtggagctgggagtaaaatccagctttcctgatttctggttaaaatatctgcagtgatctgtaaattgcaaatatgtgcatcattccatagataggcacaagtccacagagaacattctataagtttctctaggcaattccactataataaaaatgaggaaatatccagatccctaacttgggacttgtagaagaaaacaggctgccaataaaggcatacctactctgaattgttcatactcttcctactcaaaatcacaatatcttcatttgtgcacaaaaacacagtgctccttgagaggtcagcagaagccctagatccctttggagaaggagaacccgctagaaagtgctaagggataagctggggcacaggtatagggatgatccagccagtgagttgatgtgaatgagtggacttggcaccaaggtttgggcttctgtgcctctctgccctggcagtgtggaataggaggaaaacttgcatttacagaaccctgcactgagagctctcacataggctaatacatttaattctcataactctgaagacactgaggctccaagaggttatacaactcactcaaggtcacatgatccgcaaatggtggagacgggagtcaagctcagccttgacttgaaagcctggcccttcccaccaggccaggcttccatactgaccggagaaagctatggcgaagatcccccctgtggctgcatcacggtggaacttgagcaggacctggttggatgaactctgcactgttttcttggccatgctccgggtgaagacgccgagccgtggtgctgtttgctgtggcccatccctgtacacaggaaacaaggtcctggcatgtcactagtcaccatggctgcctgctccacttggtgccatcagtggccttaagacagacctggagtgggaggctatgattctttttgtaccaacacttccccacaccatgccctaaatacctctcccaaccgttcccaacttggtctcccaacatagttgatagaattggtgaagctcacactgattcctcatccacctgattcttcaccagcccaatgggctcctgggcaaatttaggctccatggagcaggggtgtgggtcttaccacaggtcctctcagtctggggcagcactaggacagggctgaggagctggtgtgaaaacctgctgctatgcatatcggctccatgctccattgccttgtcttccaagcaaagagtatacccacaatgccttttgggacaaaagatttcttccctgaaaccttatctaacccctcctgtctgttcctagccattgcttggaaatcatgctggaaattaacccagggcagtctggttacagttatccaagccctgggaattttggaagagaattcccctaaccccgatgattctcagaatggcagtaaccaccaaacaaaggaattttaaaattatttgctcttccaaagatccagtggtttgggaagaaactgtccaggaaactgcacatatcaaatgctaatttgtattcccaatgtaaaattaactcttgttgtatataactacataactcagagctgagctgtccaattcagccactgccagccacacatggctatttacatttaaattatcaagattaaataacatttaaaaatcagaccctcagtcatatccaagtactctgtagccagtggctaccatattgggcagcatagacatagaacagttccatcactgcagaaagttctgctggaaagtgctggctcagcaccagatgaccaacgggacatcacaaaattccacctcaaatctcttccattagtctgggtggcttagcccaggtacatgtagaatgttggtttgaactctggaaataccgaggaaagtctgtgtacccacacctactcccattaacacacccactggtactttccctggccctggcagggttgcaggctgggagccactgccctcccattcctctccctttaaggagccataatggccagttggagctgagccccattccactatgtttatttgaaacccaggaggctgacagcctttaaaaaccattcacctcttggtttttctaaaccaataggtaactgactggtaacccagtgtagaaccccagtaatgctcctttctaattggctgttgacatggcacctggcctaccagatggtgatgaaatctccagagggctctgtctgcagcaggctgaggttgaggcggacgccatggccaatgggcacggtgatcagccagacacagtcctgggagctggagtacgggctagggaaccccggggagtacacagtgccgttggaagaagtgatgttcccgccacaagggactgccagggagggaacacaaacgtaagtgcagggcctcggtacccacctgagaattcagatgccttcctgaggaaatcccagctcccagaactaatcatcctgtcagggaggttgggtgggatgcggaaggggaggccaagctgaggatggctgcacctggttctacccaccagtccccacacagaacaccctggctggctctcaatcatcactgcaggcccctctgtgggtctgcctcagcctccctctttctctttcttatgaagagaactgccaagaagaaaggatgccctgaagctgtcccctctcccttcccaggaatgggagggagcagacgttagggtcagagctgcagtgcttttgctgggaagagctaagaaattaggaaagtctttctttcttcctctttgatctgctctttctagagtggtacttgtggtctagacttcgagttgagggttcctggggtgaggctaaggttgggttcaaatcatagctgaacgatgtattgagcagatagtcttagataagtagtttagcctccctgagtctccatttcctcacctgtaaaatggaactaagaatacctcccccataggattgtggtggtgatgaggtgaaacgatgcaggcaaaatgttcagcccaggccctggaagaggacgcatttgctatgtagataagatcctctctccttatcttcctgttccccaaaagcaatactcaattttagtctcactgatttaggcctcaggcaggaggatgaaaagactttgacatcttcatggtattcagaatcagtcaccatggaggaaaatagatggggatggtggacaaaaatccccaaacaccatggtccagaataatgagtgttgtagctgacatggggcatcaagcagacatctggttggggcagaccagactgaggagagagaatcccaacagattccaagcagaggccaggggtcctgtgaatgcacgtacatcctgaaagtggtgcacaggtacacgccatccctgctacataagctgaatatctcctgggtgccagccatggcctgggagacagtggggaacaaggtactctagttctgtcccaggcacacacaccactgggacacagccaaacacaccagcatctgtagcacaggctggaccatgtcatcatcatgaatgccacgggggtgtttgggggagccctgcatctggttttgtgagagtaagaaaggactccttctagaattcatatttatactcagacctaagggatgactagggttaagtaggcaaggtaagagagaggaatgctgtatgggaaaggaacaacatatgctaagacccagaggcaagaaaacatggcacattggaaaacaaagtatttcagcttaggctggaacataaaatctgcaagactggagaatatgggaggtcagcagggactaggccctaacctaagggtcatgtgtgctatattaaggggcttaaaatttgccattagggacatgggagaaagcaagagagtatggtgtcagagaagccaagggaagaaggcttctgaggaggaagaacagcttctggctcaagctagcagactgagaaagcgctgctcttttctctctcctgtgatgccacaaaaagacaaacaaggtgtgagaatggaagaaagcccaggatgaggcttgttgcacagcacgtgatgggccaacaattgcggaatgaccaactggttacgcagagcagagctctgaaaatctgaaaaactaactgaggctataatagttttagaaatcatggttttacattccaacaccagaacggctcagtttcgcaaacaaggtcctctttccatcgagagttaaactgagagtttgagtctgagagtgagccatctgtgaagtcctccagctcttgtgaaataaagatgagaagtcccactttactgaggaagaacctgaagcttagagaggcaaaggggtttgagttggagcctggggtgatctgatcctagagctggggcactctttcctggattactgcccttgctaaggcttcctttttcaagacaaatttctgccactcctccaggaaaatgatgggatgccagaatgaagagggaaggcaaatggaactgaagtgtgcagatgagggtggaggcagcacaagctcttggtcaccttccttcctggttctgggtaaggaagaagacccaagaaagtgccacctccagctccctgatagatcaactcaggtctctccagccctgtgtagaaggagagtataatggagcagggagggggaagatgaagaggggagcaagagagttcttataaagaggcttcatgctcttctccctttgggcaggtgcctggattaactctacctctctagctctcagcataccactgggctcccactccctcacatggagccttcccttccaatgggagtcctccagtctgtcagggtggatcttcccaagggctgggtgtgtcttcctcttggctgtggcccacatctcctccaggtcctccctagtgctggcccggagccctgtcaccaggaccctctccctggagaggctgggccacaccatgtgaaaacaggatggaccacagtttgcctggacctccagccctggagatcccacagagcaggtaggtggaacatgggattgctctggaccagtctccacgagtaccccaggaagaactgctggggatgagggagcgacataccttcacacttgggcagggggtggtcccagttccggttggtgccatgttgacacgtgaggacagggtggccagtcaattgataccccgggaggcactcgaaggtcactgattgtcccacgttgtagccagctcccctcacaatgccattggcaaagggctctgggtctgggcactcttgaagttcataggctggaaaagatccggagaaaaggtcactttattctctctgaccagaaaataggagcggcagaaagcatagtggtgaagcctcaagatttggactcagatggacctttgtcatgtacaagtcattggctttgggtaagtaatttaacttgtgtacgcctcagttttcctgtgtatagaatgattattttgaggactaagtaggataacacatacatagctctttccacagtactggcacatggtgaaagctcagtaaatagtatctattattagtaattccgtaggaaaaggaggctcaaggaagacattgctcaattgaacctctattcactgagtgccactgggggccaggcaccagcctaactcctttcatgttgcttatctcattgaaccttcacaaccaggatcaagatcccagacataggaagcggcgacgggaggagttgagttggttctttccaactccgagagatcaaaacctctcaggaaggaagaaatctggtgggagtaagtcaaatctgtggcaaggagagaagcttttcagagggagtagctgggctaagggacgtgtggctgtcacaaagcaagtccctccaaagggcagggaagctgtttccatgagagtgggtggcctgactccacaggagatgcctccatggaagcagctgaggccagtccattggggagaggctgctgagggattcctgagcaaggcctttgatgaattgggtccacaggacacagaacagccttcgtggcagtaattgcgcccactccactcaggaaattggcagcgggaggagacagaacgttcctacagtgggaatcctcagtggaagtagttgggactggatagatgcttcttagaagtacatgtgtttctcatacgtaataacaacatcaataacgcggatcttgaagataacatttcctgagcactcacgtggctgtgttatgtttccattcagtacctcacagggaagtctcagggggaggaactgggcaggtttccctgggaaatcattgaggtaattgggtgtgccaaaaactgagcaaccacatgggtggggtggctgcttagccccaggacaggcctggccctgcagcacgggggtttgggccgtttggcaacgaaagtctcagcggaagcagggggccttttgcccagggaggcaacccaatgggatgggttgggtctttacagaaaggctcagggtagccacgtggactcagagacggggagagaaggaagggagtggctgtgtgtgggaagccaggagcagccttgatgagagcagctgggcctctcctacaggaatcatctccagtggaaggatctaggctcttcaaaaagacagaaacttcagtgagagtacctcaacactgagagaaacctcagagcctgttcccctgcaagaagcttcaaagggagaggttggccatataaggcagaaataaaccctaagaggaggaaggatgaacttccccaaagaaggactcctcaggaaagcaagtgggtttgttctaaagggacacacctggtgacagtgggaacacacttccaaacaaagtgccataatcaggtagatacaatttcaagcaaaatgccattattttaaaacattaataatgatgatgcctagcatttggggacaattgtacatcttagccattttgctaagttctttataaacagaaccctcctgagaaattgtcatggaacacattaagcatgtcggaccgggaggcctggctaggagttgcttatgctgctactaagaacttgatgggaatctttacttaaagaagagaaaagaagaccctagcatgggaagtgcagagtatcagttggaggaattttgagaaagagtaaagagttggacttctaaggaaagtcgaggggccatagagagctgggtctgacagaaacagcctcagtggggacaaatggctcgttcattgaagctgggtttttccccagaggaaaaacctggggagagtggtcagagcttgcttacgaggtgccgctccgtacggcggaggaaggtgtaaacagagagtgtgggcttatggtcagggagagttatttgggcctatcacaaatgatgaggcctctgtgggaatacttaggcctctggccctagaggcaacctagcccaagaggttgggatcgccccaaacgagaagccttaataggggtggagcccaagtctgaggggagcaggtgccccggcaccatgtgtggctccacaggagtccttgggactgtggcagacaggtgaacgctgagggagtggctgtgcctgggactgaaggggaacatccaggcaagtcctgaaggtcacatgcttgtgggaggagggggcccattatagggtggaagccccattggatgtcgctgtgcctctcacatgttgggccaactcctggtggaggagctgggtgtctgaaggcaactcgctgccccctggcctccctacgcagggaaagttatcagaggaggactgggcctgtggaggctgcaaacctcagtgggagagacaggcccatcccagggagggacactagtcccgaatgttggcttgtcgtccaggaaacctcagggggacagcggggccccttgtgcagggtggccatagtgggagcatttccaaagatgggggctggggaatcaggggcgagtgagcccaaggccagggctctgtgggggtagttaggcctcttctgtcgagggagtcaatggagaatctgaggcggtcacacaggcacaacctttacaaggacaagtgggctcatcacacggggagcacagcgagtggctggtcccatcacagggattcagtggcaggaccgtgcccattgtctagggtgaaggcacagtgcacggggtgggcccagggcagctgtccctggcacaatggtggcactgccattccttatatttatccgagaaggaaggtctcagggagagagcacttgggcctgggaggggtgcaaggggctgaaatatgtctcccaaaattcatatgctgaagacttcactccttgtgaatatgaccttatgggaaatagacaggatctttaccaaacttatggaaattaaaatgaggtcactagggtgggctctgatccaatatgactggtgtctttatagaaggtgggaatttggagacagaggcacatgaagagcaccatgtgaagatgaagccagaggtcggggtgatacttctaagagctgagaatgccaagattgtcatgaactaccagaagccaggggaggggcccggacagagtctccctcatgggcctcagaaggaaccaactctgctgacaccttgatcttgaccatccagccccagagccattggacagtaagtttccgttgtttaagccacccagtttgtggtactttcttatggcagccctaacaaactaagacacaggaaagccttgggggaaggcgttgcatctgtctctgagaggacatatttgggaccaagtccctcctgtgacatcacggccatccgacgcgtcatgacctgtttgacaggtacacacctcccagataataggcacagacatccttgggcaaggctggcctctgtgatgagcctgcacacaccttccctgggtgtggcagctgtgctaacaccagtgaagtggctctgtctgggtgcaaggcccagcttctcctgaggctccctctagatgacaagcccagccgcacttaccaaagctttccctgagatggaccccggaaccctgaagtctcctgcagaactgattcagttgcacccacctcgtgggatgccctttaaggctttccctaaatgagaagcccagtaccccctcagtattcttctctggcaagggaggagctccatccccaccatattatttccagaataaagaagtcaactctcagaaagctgcatataggatggtactatttatatagaaaacgtggtcaaaaaattttataaaatgttacatatttttcacaggtacatgtagcatacatatatccaggcctggaaaggtcacaactaaacaatagtagccgtttctggagaataatcctgggtttggaggctatagacaaagagagctttggccttacttgtaaggttttaatttctttcttgtatttttctttttttaaaagataaatatgtttgtaaattgtttgtgtaattaaaaattaactttaaaaaacaaaattggaaaactatagtacgatccaattttggctaaaaatatagctacagcaatatatataccgagaaaagcggggaatacatattgaattgttgaaagtgtgtatctctgcatagggtagtgacaggatgggattatgggaggattttgacttcctgtgacgggtgttagggcctgaatatttctgtcccatcaaatccctatgttgaaacctaatccctcatgtgagggtatttggaggcagggcatttggtggcccaccctcctaaatgggattagttcccttataaaagaggcctgagagagctcttttgccccttccaccatgtgaggacgcagtgagaagatactgtctatgaactagaaagtgggtcttcaccagacacggaatctgctggcactgtgatcttggacttcctagccctcagaactgtgagaaataaatttctgctgtttgtaaggcacttggcttatggtattttgttacagcagcctgagctaacacaatgtgctcacaaaattatctacagtgtttagatttttttttttttttttacaaacatgaattagtattggaaaaaaaatctaaaaatatttttaaaaattcagtggaagaatctgggaaagggattagaacaaatgcttcggtcagtcacaataagggaagcatccaagggcgaggttgggcttactcaggaccatgtacagctgcacaggttgggcacaatctccacatccacaggtgatggatggtctacaacacaggggaacctgagtgtagatggggctctttccagggaatgtcccagaatgagtggggccggtcacgggatcccacttcagagaggtggagctgtggtgagtgtggttgggcctcacaggaaaacctgctccttgtgcaaggcttagaggtgcccttgggactgttactagaatcctccatcctgtcataggaagagctttgctgagagtaattgggcttgatgtgcagggaaggaccctggggaagtaattcagtttatcaagcccgaggggaagtgactggctggacagtttgggacacctgagaaggcacagatgggccacttgcccagggacagctgtacagagtgggagcctcagagggtgctgttgggcctgccactcttgaaaaggctgtgggagaacttaagctgacaaatggggtccggagagatctgccaccaaaaggaagcttccctgactgggcctgccaccgcaacccaccccttatggtgttctgttttcccccacatggaaggctgggaaggtgggtggctggggcaagagatggagatagacagagaagcaaaggcggtgctccttgtccttaccctgatactccagcttgaatcctggccgattctgggagtggtcgctgtggaaatacacggtggtctcgtgggacgtggagaggagggagcttggaagctcgcttccactgaatcttcccatcatgcggctggtctcataggggccattccggatttctatgtagtcgtggttgggctcggtggagaagttcaggaactggatgtgagctcctgggagcaagacagaggcagacagtgcccaaagcaacacagtcctgcctcaagtgtgctgcctcatgaaagcagctcctgccagagccatgagtccctgctactgatttcccacccagccaaggctcctagaactggctttgggaattgcccgtccagccaagtctcttgtctttgacagggctgaacttaaaagtgtattattcattcaaaaataaaggcatcagtcatttcagagctccactggagttcattttattttgttgaaaacaaagttcagggtcaacacttgtttaaatttatgattcatatgtccaatatcagcataaagatagttttgctagaataaacttttcatttaaaaataacacccccaatacttaatcaaaagacaagaccttcaatactgctgttttctagaactcttatgataattcagaaacgtagggcttagaagtatacattgtcccctctgttccataaagaagccaaataaagtttctactttgggatcttagtgagttaatcaagacattctagcaacctgacaggttaaataaatctaattaagttcttaatgtacatagtaatatactctttcaagaacgaaggtgggaacatttatgtttgtttactgataagatttttcaaaattagatcaccatggaaaatgttattgaagaaatatatttactgagcataggaaaaagcccatattgcattgataattgtaaaaatcagatgacaaatagtatgctgtatacaattctaatttttgtattataaaacatggaagaatattaatttgcctgctaggaatatttgctgggcatttgctgtacatcagggctgtgctaggcattgtacaggatgagcaagatcaagaaggtccttgtcttcatgagacttacatggtaacgctgggagactaagccattagtgattatcgctgcacgatgagattatagatggattttcatttttaaaattggcttatctgtgctatcaaataagctcagaataagcacgagtataattctttttgcatctgatcatttaaagaataaaataaagactcgacacttaatgttgaagatctttcatctcctgccctgttccattcctttcctgccctccacagaagcaatcacatgaatttggaagctatccttccagttcatggttttggattcttaaatatgtatctgggtttatgtgttttcaagatttacataaatgatattatactgtacatacagttttttacataatattgtgtttttcaaggtctatccatgttaatatacaaaaatatagttcattcattttaactgcatgttaattccattttatgaattatccaaccatacagttcactccccaactcatgaacatgcagattgtttccaagttgcagataattttgtgatggtttttttttttttttttgagacagagtcttgttcggtcgcccgggctggagtgcagtggcacgatcttggctcactgcaagctccgcctcccgggttcacaccattctcctgcctcagcctcccaagtagctgggactacaggcacccgccaccaggcccagctaattttttgtattttagtagagacgggttttcaccgtgttaggctgtgatgacatctttgtatacattatctgaggagcctgtgctttccattccactgcccaggcatcgtcccctcatataggagccctgcgggctgcaggcccacagaaggggctctttaaggatggcggaatttctgacttgaactccaaggaaagaactggactgtgaccgccatctagtggagcagcatgtagctgcagcagctctttacacgctgagaccaggtaccaagttagggacctcggcagaatccaacattaacttgaaagcaagggatcccgggcctttgcaactggacccagcagtagcttcttccctgaaacctgaattagcacccagaatttagaggtgaaaatggtggctgaacataaggacttacagggaaagccacctcattcaaacttctgtttgcctttggatgttgccctccccaccttctatcatcttggttctgcctcaagactggatgcagaggtacagggtctcccagatcctcttaatgtctcaaagtctggagtctcctaagactgccgagggcgtcatcgctttgctcccagtttccttcagaagatggtactgaacacccagtttccttcagaagatggtactgaacagaaaataacatctttcagagggccaccaagctctctcctcccctccaaccggatttagagaaggccagttagactgctttctcccaaaagccccttccctaatctctaatcacactccaggctgaataatgaaggataaaatgggagatcttcatttctgaggctcacagactggcattcagggctatgcaggcataatccccttgggacatttcattcctagaagcagtgcaatggcttgggcaagatgacccgtgcgtacggcccatcagttccatgtcagcacaaagccctcatcccttcaacagagacatttgggttaaatgatattcccagtgcataatatgtggatcaccagcaattacattttgtacccacactgatgtcctccacaccctgacaacctcccatgcctagcatactccagctccaaaaacaaaacaaaacaaaaataaccccccaaaaccaaaaaaacaaccttcccagtctctaggccagctagaatgtgcatacgaagaagaatgcaaactcgatttctcattgatttggctcaatttaattaggatgataaattagacactggggttaaaagtacaacttgaggtccagtctctgtacgacagatttccgccccacccccgcctttttttttaagtccctgagtaatttatttttattttttatttttaatatcaagtgatacagtgttagttaggtataatccgagtaatttctcattccacattcctggattttagtttatggctcaaataataataatggcaacccctaagatttttctcccccctatatgttaatctctgccattcttaattggtcttcacaattgtacaagaggtcaacagatgagaaaacagagaggcagagtactaaacagacttggcccaagtttgtgctaagagattttggcggacagtagttttaagctcaagggtctgggcttgaagcctgtctcctctgggggctgcagagacttaccaaagcccacgggcagtgctattttccaggagcagtccatgttactggggtagttgcctgggaagccggggctcaggatcaccccctccatctcctccactgttcccccacactgtgctgtgacaatgagatgagacagagggtcaggacaacatcaaggggtgtacagggccctgccaatgtttggaagctcccttcaagcagcagtttttaagctttcatgagtcatatagccccttgagaatccaaaggaatcttcttaaaagactaagcccacgggcaacattcaatatgtacattcaggaagggaggtacattctaggacagcctaaaagtccacaaacccaagttatggactcttgaccttgaacatgcccttcacaggtcagttccctggtgaggatgtccaggaaaagtgaggaagttctgtgccaaaagaagtccaaccatttcttaccgtatcccccaaatctccctctcctcactgcccaatctactctttcaagactgcagaaaaaggatgaaggaaggggactggcatgcatcaagtccccactctgtgcccggcaccatgccaggctcttctcaaatatatatttcagggggcagggtgggcggcaggggaggctcaccacgagcccatcctcagaaaagtgacggtgatcagcatcccacaggagccaaccaccaggctgtctgagtgacccaggggcttagggacatctgatatgccaatcaaggtgaattcagagtcatctgaggatgcagggctggggcacccctgcagtctggtcagttgacatcagttcttttcttttgcatcttattaggaaaaggttgtgtgaacagaaaggggctagccagtcttagagacccagggaaaggatcatagaacagggattggcaggtccaggcaagtgctttctggggagaggacagcttggcaaacagacccgaaaacagtgcagagtaggctccagcctcgactgcctgtgtcacaatcccaccttcacttccgatgggaccgtgggcaagttcaaaaccctccagaactcggtttcccacaactgtaaaatggaactagtgacagcacccttctaatggggttgttgtgaggtcatatcagaaaggactgcatttacttgggacaaggctggcacatgttgtaaacccctaatgaacagcagctgccgttaaatgaatggtttccatagcaaggtctttgtagtctctaatgggggaaagtgccttgggctgaccgttcacatttctgacctgctccacagatgcctatgccctacaccgtggtgaaaccacagaagagaaatgccatcgtgcttgagtgtcactcccttacctccctgccccaaggtcagccttgaggggcacctcacaatcgactgggcaccagagaaccttaggtttccgttcctgactctgccacttcctttttaatcctaaaagactgagatttcctgtttgcaaattgagggtaatggtacctcccctgcagggctgatctgaggaaatatgaagctccatgcctagcatatagtagatattaaataaatgtgcctttcttctttgcctaactggaccagaagcttctgaaggggagatgctgtcttttcttgtgtctgctgatctgctcatcactgccgtagcacagggtaagggacgaagccaagtccttgtttcgcacgtagccctcagcatttcttttccttttttcttgtctttcgttttttttttgggacggagttgtgctctatcacccaggctggagtacagtggtgcagtctcagctcactgcaacctccgcctcctgggttcaagtgattctcctgcctcagcctcctgagtagctgagattacaagtgtgtgccaccacatctgcctaatttttgtatttttagtagagatggggtttcaccatgttggccaggctggtctcgaactcctgacttcaagtgatccgcctgactcggcctcccaaagtgctgggattacaggcatgagccactgcacccggccaacctcatcatttctttattagatttgtctgtctgtcccacaagaagtcacgggggaagcccaaagtgcctagaaattccatctgggatctggttgattaactagagccagaacggtcatcatcatgttttcaaatgggcagacctcctgtaacttttcatttggtggggcagagtttccaaaagtgatgactgcattaaatgggagttagagattataaaaacatcagtttaaaatgactgacttggaacaaatccagaatatcaaactttcttctgatttgaacttgaactcaatgatacactactgagctaagatccctgagagaaaattggttggaatgaattgtaaagtctgggctgtcttaccaatacagagtggaggagggtagttccatcgccgcactgttccgggcatgcaggagatgtgggcgtggccctggaggaatcaggaacagggatgggctagctgtccccgtgggcacaattgtatgtacaaccaggggctgtacaggggtctggttcaggggcctcatgttaaggaacaagatacacaaagacacacagatccactgtgggatgggagtgaggtagagggagagagaatttggggaaggacaattattaacaacgattactaaagaattctcattattagaggtttccttgtgagagtcctttaattactaaattccctgatggccttcaaagggaaattaaatttccctaaagccgaatcaaacccaactttgcaggaacacattggaggttggcttgtgccaaattgttaaagtcagcagagtttatcttttgcatgaacagctccaggagaggataatggtacccgggggacctgggggctgctccctgttctttggtgactgtagctctgctggtgtaaggctggccaaccacatctcaggggacacctgtttcctgctctagggtgtcaggggaggtacctggagggcatatcccggctcacactggaaagacaccacatcattcaccaagtagcgctcgccagtcttcaccccgttactgggcacagcaggttccggacaactgctcaggcccaccgctagacaagacagagacagaaggaaaggagaatggactagcccagcaggtcaacgtggcggtaggctggggtgagatgctggtggcagggagaaggggtgcttctaatttgtgctttctctcatcctgtaggctagttcttcccaactctcttcaccttgcagcacacagagaaaaagagtatatttacatggcacggaggctcaacagaccaaagctccttgagaaggtgggtgtgatcccaggggatgctggctgtcctgtccactcactgagctcttagctagggggcttagctagggagacttctctgcatgctctcctcccacatccctcctgcttcttactcttaactcccctctgtcttccttaccctaagaagacagatcctgtgggctaagacagagagacagagagagagagagggaaaagaaggtcaagaaggaaggagagcagggagggacacatcagcgatgctcaggggctcagttagagtccgactttccaagactctgagaaaagtgtgttagcagataagactctccactgccttatttctcctgttgtgttttcaaggtcaggccagcccctttctgggagcagcactggtggcctctcacacttcaactcccgtgttcagctctggcctcactgagcactggccccgctaaaaccctccttcatcccctaccccaagccactgctagtccagtccaccctgcactcacaggcaactcgtgttgcttaaaatctctccttgaattgtgggacctccttgctcagtgatttgaagcaggtcctcatggcctataatatggaatccaactttctcatcctgatgttctaaggactttcatgatcttggcctagtcctctttcaagatcacctccacaggatctcaaatgctcctccttcagtctcctttcttgacttttcaaattcaacctgcactcatttattcctcattacatgcctggcattgcacacaatgttttgctagagcacccagcttaatcttcctcctcctcctttctgccagtccataccatcttcccaagagaagtgctcactgagcacttccatgagcaaggctggggcccattggtgagggtatcccctcatacccttcaagcaggtcttcacatcccatttcacagatgaggacacaggccataggaggcactgaaacatttccttagtaagccacagacccaggattcagaccaagcccagtctgaccccaggtcggccaagcagaagccaagccctgaggccacatgagcccatgtctgaccctgtcccctgctctccctgcctcccctcctaaaacagtcctcatcctgctttgaatccctccctggctgcctcccacacagcaaatgggagtgtagcatttccagacagggggcttcctgcctctcctgtgctctgcaggagtccatgtacaggtgcaggcacttcacatgcactaaaaagtttctgtgtcttgctggactggacttggagggcacttgtccaggggcaagggccagaagactcatgaggaggcggagaggtagctgtaaactctaaagtggtcttcctaaccaaggcggcagaaatggaaggatggcagaccgtatctgggtggcatggcccagagaatgtgggagatggcagccttggcccttctggaggctcccttgggggatacaggctcctttgggggatacaggctccctgaggagcccacgtgtatccagtgcccacaggcagctaggggctcatggaaaagaaacaggaaaggaccaatcagcctagaccatcagccaccaacccatcttcccaggcagcagctaatgagtcctcatgccacattcagagatgagactctgataactacatgtgctttttttccctctgagggaaactcacatataacaaaatgcaaaaactgtgcatgaacatggtaataatcaagtaaacatcataatcttgagtgtacatgtgctgagttttgacaaatgcctgtacctttgtaacccaaacacctgtcaaaaccacagaacgttgctatcactctggaaattcctcacacttttcccaggcaattcctgtcccacatgtgcttttaagatatgagtgtgatatttggaaatgaaaactctttgagccttgtccaaaactctcagcagctgagacaaaagaccccaaggacaagcattaaaaaaaacccatcaaactgagtttcaagtgtttcacttgtcatcttgtctatttctccccattcctctccacactccaagtagaacaaaactcactatttagtgcagtagttgcaactaactagacctacttattggaaagacctacttactgtccagtgatggagagaagagcagaatgaggacaaaaaagcgtggtaggaagaaaaatggaatgggagaaagatgaggctgaagagaaaaatggagggggatatagaaaagtccattctaacttatcttatgctacacagattgattttatttaagccatgcttacaacaaaggaaaaattattttttatcatatgtaatttattacttttgaaagcatattgctccatttccatttaaattaaataaacaattatgaatcatagcagtggatgtgacttttcagtacccttcaaaaccatttgcctgtacaatagcagttaattctctattgtctgtgagctctttgtagattatcctacaaaataaaatataactacagggccctggctcctaggaattccagtctccaaataccagtgggaagctctgtttctccgtagctcttcccatcatgaggggacaacacatgaaatgtcagctactgggaaaactgccagtccccttggacgaagaaaattgagaagaggtggatttttttcctgggaatgaggcagtagaatggcaaagtgatttacaaagaaaatgtatctttggaagaagaaagaacagagaagattctagggaacatttaagagctcaaaatattggatagagaaaactggagagaacagagaagaagggatgaaaggaaaaaaatgtgatttagtcgagaaacccaggatatttcactccaccaggggagtgaagccttacatatctgctggaaggagtctcagaggtccctgtcctaccctttaccctgcagggtctgcttctagctgtcctgggtcttttttttttttttttttttttttccaggtgcatgcttcagttctttcaggtgatgagcatcctgggacctgtttaattctttctgaagcagctggatgaagttcatttgtttcacagacccagatgggcatgtgcataacacagttctgacccaatcagacatctagcacccagtgggccttctttctgcacaggcccatgctgtcgcagatggtctagccaaccatgccttcctgcatttttcacttctcattgcaaacttaactcaggcatccccttctgcaaggccttacatggctagctttagctcctttcctttgtactttcttagcatctctcctttcctctgcactttcttaggtttcactaaaatgactgtgcccatgtccatctctccttctagattttgtgcttttgaaggcaggggccttgtcttattgacctttgtactgcggggacctaacacagggcggggcacattgcaggtgctcaatgtttcttcacaacatttgcatctccacccgcccacaaccattctctcccttgaaccatttctctaccatctagagccatccatgagagcacctgtaatgctgtcatgcacctctctgtctatgtgtctacctctctttagtggactttgactgacccatcttaatctttcccaatcgtggcaaaacccagcacagtgcctggcatgttgtaaatgctcaataaatatttgccgaataaaagtgtaaaaaatgctgctgcctacctattctttcctgtacccagtggagaaagggggtagggcaggcagtcccagtatgcaagcagtttccctagaaacctctttctttgttccccagaaggcacatccacaaatctttctctgtgaagagtatttggtagtgaccacttagggatgccagaagccaggatataagggtttgagcctgcagtgagaaatctggtagaagatgagtgaggtagccaatgaaaggaggaacttcaaaaataatcgcatcatagaactaggggttagaaaggccaggttttagacctgggggaggaaagcacaattttcttacatcccaattatatactgggaccttggccaatgcaagtccccttcccattcctggtgtggatactgaacaggcatacaggttttcgagtaacagacacttggacgagaacacagccttgaggaggtttcagaccttctctgggctttagcatcttcacctaggtttgtgggaaggcttaagtgggatggacaatatgcagctccagtttaatccttgctcagaaggggctcagcaacttttaggtcccaccctgaaccctgtaccagccaagaccctggattctcacttttgtactccaagtggaagccagctgcagatacgctgatatctgagtagaaatgaaggtagagctggttggaggtgctgttcagaagggcaggcacggttgttcctagggcaaggacaccagggaaaaccatttaagtttggctcctccaggcccttgcattcctccccattcctctggattttgctacctgctgacattctgctcccaaggcccccagatgtccccagttatgaaactcactaaatgacaaattagcactcctcagagggctaggtctctactggctgagggaggggaaactccaatctgcttcctgtaagatgagcagtggcagagccatgtgcccgcaggagggtgagggatgagttgggtctcctcatagccatcttcaggataactctgacctgtattattctctgggcagtcctgcagtgtggacagtttatctgaagcatgtgactcctctttatctcttggccacctagagttctgggcctaaaagattcagataattgccctggccactgggcacacctatacaccacactcagtcagaagtccattactagaatggcaaaatggtgttgccactttggaaaacaggaagttcctccaaaagttaaacatagagttcccacatgacccagcaattccactcctaggtatatactcaagagaagtgacaatgtgtgttcacaccaagacttgtgcatgagcattattcataacagcacaaaagtggaaacaagccattgactgatgaatggacacacaaaatatgctctgtccttacaatgaagtgctgaaccatactgtgactgggggaactttgaaaacatcacgttaagtgaaagaagccaaacacagaaggcttccatttatatgaaatgcctggaataggcaaatccagagagatagaaagtagattactggttactagaggctaggtgtgggctggggaggggagtgcaaatgggtacctggtttattttggggtggtcaaaatgttctgggattagatagtagtgatggttgcaggacctttcgaatctcctgaaaaccactgatgtgtccacttgaaaatggtgaatttcatggaatataagtgatatctcaataataataatgataataacaatgttcatgatgatgagctctagtactaccctccaaattgaagcccctggaaacccagcttacctgagaaactccccagcatggttacagtgttatctgcaccatcaaatacttccagcgagtcccagttctgctctgtcacaaaactgacaacttggatctgggaagggagaagagtgaattgttggttaggcagcctgcgtccctccctccttctctgctttccctttctgcccttcccgtagttaattcaatttgttgagaatctactctgggcctaacactgtgctagtccctttcaataaaagtaagatgcagaaccgactccaaggagctcgttgtccagtggggaagacagatgtggaaaaaaatgattagaagacagtggatattttgcaaggcagagaatggggaaaagaagttccaggaagtggaaagacagtctcactgactgtctcctcatctctggaatgttccttgggtttccccactttcctgccttgatttcatcagacgtcctgcagcaatgagcccgtaacccactcctgcccagatctgtctgctggactcccagtttgctgcctctctgttggccttgcaggctcctgaccctcttccctgccttgacgccaatgctggggcctccctctgcctggctcttacccctgggtaccagttatgcccccagttcagcttctacagctcatgctgtgcgtggttccctaggtgtgtgcctgggggttctctgtgcttcagctgtgctgggtgctttgctctttcttctcattagcactgcctccccttctaaccctcacaatcttaagaaaatctttagccatttgaggaacaacttctatgaatccttcccacacttcagattccagctccaggcccatttcttcttttagcctcccctcctggccatggccaatcaatgcccacctctcctccttcctgggttacccgactcccaccgcatgtccctgaagctcttggggcctggaacctgctgtgttttctgcatgggagccacatctccacacttggactgagcctccttagccgcaggggcaggtacagggctgatatgtctcttcctggctcaccctgactcaggccttggcaccagccagcacctgtggttgtcacctgtgagctgttacctgggagcagacggccacctgcccgaccgaggcgcccccttgcccctacctggatgccagcgccttcggggaccacgatcttccacacacagttgaggctgttgaggtacggctctgggaagccaggggacaggatggtgcccctgcgctctgtgaggttgcctccacacggcactgggaggagaggccatcgggtcagaggctttgtggcctcccgtgggagccttcccaagctgactcctccctcatggcccccagcctctgtttgtcctcctccccatgggggtgtctccctaatgtccccagtcctgccttctccacggcctctccccatgcaactctgttcggggccctgggcccagctcctctctccacgtgtgccccgtccccagtacaccggctgtcttcacacagcccacagcgccggggactggggttgactgggacaccccacctcagccatgcggtgggaagcggctgctgtgtgtcgtggggcatcactggggctgactgcctcccctacagagaaaggactacgtgccgccccccgcaccctcaacgcccgggtcctggttactcacccacacacgtgggcgctgagacattccattgggccaaggccccaggcacagggaggcactcgatctctggcgacccctgcagggcatagccggagttgcattcgaagcggacgatggcccccaccgagaagtcactgcccagcctcttgccatagcggggttccggcacagagctgcactgcgtggcgctggttcgaggaaccgctgtgggggacaagggcactgaggggaggcctcacccctcagaaactggcccagggacggacatacaacgggtctggaacaaagaccgtctggatgaaaccctgggaggctctggatgctctcccgtagggaagggctcgagggctaactaggaggatgcctgttataccgaattatagttggacacacagcgctacagcacagctcctggaaagcacgggaggtagagccgtggacctcccacagaccttaggcccagttttgttctttgctttcccaacgacgcccctcactcatcagggtcccacgttccctagcaaggagaatgggccttcctcctctaccttcagggcctttgccctgcctctgtcctgttttccccatgtgccttaagatcctgcctggggccctgccctccatgacccccagtctcccctccctcctgccgcccagaatggctgatgggcccgggatggcctcccctgtgataggatcactcctgcaaagagaaacacagctcatcctgggcagagtcgaatgaacaggaccatgcttagaacctgggccctacaaaagtggatgttctcctgggcaagcagaggttgggacctgggggtgaaaaccaggatgctccaaactacctttctgggccaataaggaagggaactaacaccaactggctggttggtaccagctacttcccgaagcctctttgcatcctatcagtgaggcattgtgattgcccgctccttacaggtgagcaaacaggctctgaggcctggcgtagctggagcctagctcgaaggtggggaggtgggattcaaatcgatgtccacggcacttcaaagcctgtgttttccccgcacctttactgtgcctggcagacaaaaccaagctccaggggagtccaggtaagatgcctgggctggtctcttcagtgccatctggaccatgccagacaatgggtggagtggggaaggggaaaaaactggctgcctttgtctgatttccttcctcattaaacacagaacttgtctaagaaatgtctgctgagtaagtgaatgcataaaattaactggatttcagggaattgccctacaaactagtaactgcccccaaacaccctgagaaagggactcagactagaggtcaaagatccctgtcccttcgatcacgagtcccttaagaaccgagatcaccttcctacctccggcgtccatgtcctccataccttggtagacaaagtggaagcctctggctggtgcgaggcctttggcgctgaacttaatgagaacttgattggaggtggccaagggcagtgattctcctgccgagataaggggcaaggaggagagaacagtgagtccagcaggtgggcccagaagataaaatcctggccaggaaggaggggctgccagtaccccatgcagcaattccttccacattccaggccttcctgaaataaaatctcacgtatttttactgcactttacaatttaaagtttatagaaagctttttcattcacggtcttaacttgacctgtggtcactgtgaggttggcatgacagagttcagtaccctcatttaataaagaaggaaagagaggtccagaaagattaaatgacctgtgccggaaaggagaaggctgctagggatgtgtggagcgacagggatggagacagcagctgttaccaagccggctgactggtggtttacttggaaaactgacatcaatctgagtttttaaaaatagcattggcctctaggaaggaggatgatgtgatcatctaggagcaactggtctttcccagacactctcccaccatcctgtgaaatgattaccagagcgatggtgtaatgtattgttcatactagaacatttttgagagtcaaagaaagtgctatcaatagttatggtgggactgtcccaggcaaaccaggatgtactattgccggccaataacacacaaactggggggaacctgcatgggcacaggaaaccagggtagactgacagcttttgtagcagaagacaaaggtatatcttctgcttggtgcagtacagatgggccaggggagagacagcaccaactggacctgcagccaattagtgtagttgccattctggggaagcgcagggagaacatgggtggaggcagcagcatggccactctgcctgctgcccccctgcagcctcagggacccctgagaagcgctgctgaccccagaccccattctcaggacgaagcagggattacagagaaccaggctctatctccactacagtgagggctagagttgggacccacaacggaactactgggaggtccacctgtacttccaggaagctcatgtgatgccaccaatatgggagcagagagcttttgcaaggcaggcttagatgtgtatgtgacccagaaggctgagcctggctaggagtcattgtcccagctaacagttattgcccccagctaacatgtagctgccaaagcagaaagaaactcatgaaggcaaagcatccctttgatatcactgccatctccaactcctcctccagatggatgtgagcagagtgaaactcaacttttctatttggcctgacagatgtggataacgaccctagtgagctctcacagaacccatgtcaactgcagccctgaaggcacacgggcctccatcttcaagggagagcaaatagtaaaatcactggacataagaaaaaatgttaaagttttgaggaaggagatcactctaagaagtcaaagcaaatactttatgtgaaccacaacaaagaacaggcaaaactctcagcagatgttcagtcatggttgtcatgagattaaatctagcattgcatctgtgaagtcagaggaagaaggatctgagatcaataaaggctgcaaagagatgagaaatgctagtgcaagcagctggattccacaaaaactgaacagtgaagtcgagatgaaatttgggaaattctctcagaatccacagaaaaaggataaagagattaaaataacgagagaaatgacaagtgacgtgaaagatgaaaaaaaaatccatatgcatgtatcaggaatttcagaaagagaagacagagaaattgaaggagaaaaaaaatcatttaaggcagggtgaagtagctcacatctgtgatcccaacactttgggaggctgaggcgggcggatcacctgaggtcaggagtttgtgaccagcctgaccaacatggtgaaaatccatctctactaaacatacaaaaattagccgggtatggtggagcacacctggagtctcagctactcggaaggctgaggcaggagaatctcttgagcctgggaggcagaggttgcagtgagctgagattgcaccactacactccagcctgggtgacagagtgagactctgtctcaaaaaaaaaaaaaaaaaaaatcatttaagaaagaagacacttttcctaagatgtgaggtacagattgaaatatttgccaagtgcaaggtagaattagtgagaagagacctccaccacaacacctcccagtgggctttttaattaacaacaacaaaaaaagaaaatcacatagacagaaaagcacaggttacttacaaggacaaagaatcacgttggaccccaatttgtctgtaacagtaaatgttggaatagagtggaataattactgcagttttgaaagataaagtttgacccgtaatttgatttacaatcaaggtgtcatttatatcccatgtcaaaaggaaagcattctcatatatgcatggtacagaaagtactgcagttataagccctactgaaaaaaaaaaaaacaaaacccaaaactaaagtagggaattcagacaccagcagggataaatacaaccagaaaagtataataactattgtcaatgagctaacaaaacaaaatgcaaatgcaaattcaaaaatttgctcttggggaagaagtccacaatttaaaaaataactactataacattaatataaaagtccaaatatatcaagaaaaacttgaaaattagagatgggtcaggtatgtatggaaaagcgaggaagcaaaatcaaaacaacacaaacaaaagcgcagaaagaacaacacaagatgacagatatcagaccaaataattcacttgtaaaataaatgagtcaacttcctcttaaaagagaaagacttggagaaaatgagagaagatatgtcaggaaaacagatgcaaaaattgctagatatacaagaagacaacaaaatatcataactgtaatgggaaatactttcatgcaacattcacaatcattgatacatcaaatagaaaaacaaaatgaagactgttgagtagcggtccttaagctttttctcccccaacgcaactcagggacagggacatagtgcactcccatcagtaccaatggcttgttatcagtgtttctccaaatgaggaataagggactctctgaatatactgatattgatatctacaggttttttttttttcttttgagacggagtctctctctgtcgcccaggctggagtgcaatggcgcgatcttggcttactgctacctccacctcccgggttcaagtgattctcctgcctcagcctcccgagtggctgggattacaggcacccacgaccatgcccagtgaatttttgtatttttagtagagatggggtttcactgtaatcccagcactttgggaggctgaggcaggtagatcacttgaggtcaggagttttatatctacaggtcttatacatctttctctctttctctctcactctctcatcttcctcccccatcttcttccttccttccttccttccttccttgcttccttccttccttacttcctgtttctattggtcctatacacctatatctacatccatatttacatctataggtcttaaatgtagacctctctatagctctttacttgaaaatccttactataactctaaatctatagctatacattatctatctatctgttttgaaaaggcatcctactccaggagttcctgatttacactcttggttgggtgtgtatgtgtgaggtggtggttacaaaaaattcatttggttgagaatcactgatacaatagatctgaataacaaaattgagtaagattgatttaatggcaattacaaaactcatttactcctaacactaactttaggaggtaggactctttttctttgcattttacagaggagaaaactgaagctcagagaggtcaagtattgtgccttaagtcacctagaaaacaaataggagagctaagaaaagagtgtgattgtagagcctgagctcattcgtcttgcttctctaccttacagagaacacacatccttcttaaatatttagaaaactaaaaaaaaaggtccttggctactgaagggacttcaattaatccccaaagaagaaatggtacaggccacattctttcactacatggaaataaaaatataaattaacacaaaagtttaatgcaataagaacaaaatccatattcttaggggaaaagaaaagacattcttagccaacacttgggcaaaaagagtaaacaacaccatgatgagctatttaaaaagtaatgatgatgaacatagtacatatcaaaatttatggcatgaagccaaaactatgcttggaggtgaatacatcgctgtaaacatgttctttattacacagagaaaataatgaacagagctctcaattcaagatgttagaacaagaacaaaataatcagaagaaaaatatgaggaaggaaatgatgaaataaaggcagagattaataaaaaaaagcaacaacaaactgcagaataattgataaattgcagcaataaaaattaaaaaaaacccacaaaaacacaaaacacctggtacagccgagtaaaaaggggatgatgaatgcacgatgcaggataacaaaggcaggaatatcaccactaatacaaagcagggtaaacatcaccatagtacattatatacattgtggtactaaatgtaaatgaaattatgaaatggattttttactaaaagctaaaatatcaacattgatattagagtaatatacctgaatagaccaataaccatggaagaaaataaaagaaaagccactgaaaaggaggagataaaataatgagacaaatttatttgcagatgatattacttcttgcctagaggagccaggagaattagttggcagtgtaagcagtattatgaagagtctgatgactttacaaagcaaatatgccaaaaacaacagtctttgaatatactagtaaagaccagctagaaaacataatgggggaaaaaagacccatttacaacagcaacaaaaatctccatgaaatatctgggaataaagttaacaaacaatgaatactgcctaaataaaaattatagcaccctcccaagggctacagaagataaacaaatggagagacatattgtattcctggatgggaagaagagttaatataaacgtgagttcaccctaatttaacgtgtaagttttattaaatcccagtcaagattctgatgcaatgttttaaacttaacaaaatatttctaaatataatttggaggcaaaagtaagcaacaacagccaataaaaattcaaaacaaagaatggctctggggacttatagtaccatgtatttaaaattattatatagtaaacactattatagtgttataataattaaaactaaaaaaggaataaatagacacttggaagaaatggataaaaagtctaagaacagacccttcataaaaatttagtatatgtaaatttggcattttgaaaattctgctaggacaactgattaactatatttgaaagaatatggttagattccctatatcaaataataaatcaaaataaattccaaaggtattaaagcagtgtgatgaaactaagaagtgaaagaaaacacagaggaatatttatttgaccagcataaaagcaaaggagaaaactatataagaaaacattgatagatttgatagcatgggaaatttacatattctgacattaaagcaccctgaagaaaattatatagcaaaagacaagctggagaggagggctttttatagcatattatatatatttatgtagcttataaaatatggagctctactcaataaataagaaaataagtgcttgtagaaaaatcgacacaaattcacaataaattcacaaataaaaaatgcacaggccaataaacacattataaaaatttaacctaactagtaataaaacaaggcaaattagaaaatgagataccattttcacttttcaaactgatgacgcttttgtttttttaattacctggtttttgtgagaataaaacatgccctctttcttgttggtgatcaaactgacaagatctttctagagggatatttgataatctgcataaaaagccttaaagatctcacatatcctttaacttgacaattccacttctagatattctaaagtaacagaaatgtatataaagatgtatgtacaatacattgcattactattcataagcacaaaacattacaatctaaatgttcaataatagggaattcgttacataaattttaactaactgtatgagagactactatgtagcacttaaaaatcctagcctagaagaaaaaaaatgacagagaaaagctcgtagcgaatatttcaataaaatatgtatattggtttgttgaataaaatatgtaaacgtcgaagtagatacaaagactggaaggaaatccactacatcttgtcagtggctctttcggggtagtctttattttgattctgtatgcaattattttgttttgtcactaagttttctataatgaaaatgcaatacatttatagtaagaaaaaaagttgcatctgaatacgaaccaacaggagaaggctacaccacaagggggcggtgtagacacagtctgggtgagggcagctgctgaaggccccgctagttggagctctcacgagctggctgctgcgttgtagacaagcaccagaacacgacaggcacgcagagccgtagggttccacctgcggccatggggtgcttctagagcctccttcctttagccggacgtgatgcccccggcccacaaccatccccacactggccgagccccggatacctgtatgggagcccgagagggagctgaggagccgcgagtgctggctgtggccgtcgtgaacctccaccacgtcgttgagggccgtgtgaaagaaggcgaactggccaaacaccactgtggaggagacacagtgtggggactgggcaggcacgctgggggcaggagaggggatctaggggtctaggggcccaagccaggaggagggcagccctggggaagttgttggttcctgggctgtggcttgctgcactggttagtgcagtggcacagtctggcagtggccagacacccggcacagggaggcggggagctgggaaggccgggctggccttcacaagggtcaagacaacatggagggctgcacccaaaggtcaggcgggtagaggcgaaatggagccaactttgttcctttcccagatagcagctgcagcagctatctggaggccatcagagggctttgggtaccatccctcattctccatgcgatgtcaggaccccacattcatgcgtcccaacgtcagttagtcagtgtcattgagttgaaaactgtatacagagatctgtagtcagtgctgtgagctccttatcactggagggatccaggcacaaactgcatgcccacctaccaaggattctgctctgggtagcagatcagattggacagcctttcaggacttttctaactgcgatcctgcaggtctgaggcccctgccacctcagtatattggggagtgtgtgtacatgtacataggtgtcctggttctggggcaggagtgggtgtactgatggctggagctatgggtagagatgagactgggaatttatagaggacagagaacatgtctctctcatctctgcaactccaggacccagtaaagtgcgtggcccccaatgggtgcttactaaatgtttggcgaacgcctcaagcatcaggccttgctctgtgcttgcccatcctgtcttggggaataaggagctggctctctgcaggctgctccctccgtcctgctcctcccctgggtggtcgggacatgttgatgtcctttgccacatccaacatcaattgtgtttagatatggttgttagtcctcctacaaagaggagatccaggaagaaagaagccagcctggtcacctggttgcccttcatcttcctgaatgcctccaaggctggcaggactcttgaatgtccccactgccaaccaggtaatgagcctgggttggtttttctgcccacatctcttggaatctggaagtttctctgtcttcccagggcactggtctgcttttcacttttttcttgcttgtcctacctatagcttctggaccaggctttggttctcagatgggacaccagaatgatgtggctcctggtctccctcacctgcactttcaagcccagctccatcccattcctctcctccctcctgctccttggccactcaccctgggttcctaacaggtctagatctgcggcacctcccttaggacttgggccatactgggtagtcccctggggcaccttgccttccctctgtcttggccagtttctcaccaactctgtccccttggttctggcggggctcacttgtgcccttctgccctcttgtgtccggaatgtattctgcagcccgtttgagaaacgtcagcactcggccgtccttttggggagactgttctgcgattcccacaatggggctgtatataattgggaggcgtctgaggaattgctcattttggaatgagggtgaggagtcagaaaacatatgaacaacaacaaccaaaacccataccatagtccttgggcacagtaacaaaatacaagcagatctgtccactggtgtagttctgggggtagttgggggacaagaccactccgtccgaacccacatactgtcccccacagggggctgaaagagaaaccagatagagagtcaggtgaccttgtgggcctcttaccagtgaccatcctctgttctgccccagcctgagcttctggccccagtagggctgccctgaggtgggcaggccctagcttggagaaggcaagtcctgcggaccctgccctgcccaagaacgtgcacccctggcctggcatgtagcctgaaacttgccctgaagctaccgagggccctcttgggcaggtgtcagttcttgccctctacctattaaccctggcattggtccctgaagtcacagccttagggagcacattaggaacctcttctgcttacacgtggagcctagaaatgatctgctgccctggctgacatctaacctggacagtgagtgtcagtgtgaatagggagctgaagcttccccggactaaccccatggggagtggccagcccatgtgacccagccaccttctgttcctctccaaggtgcccaatttccacaaggggcgggtctgagcctgcctctcttaccatgacaaagggggtatgcttggcttttcaatgggtggtcaccaagctcttaaagccctgatactcattcctatctctcttgtcaggacccccatggctcacccagacccacctggaatcagcacaccctgcgggccttacttcaacatatctgatctctcagtgattttccctaggcctaggaactagtccaggagccacctttaaatgacttctccctggtgtgagctccctgatgtggcatgtctgggggcctctgttgagggcatgagcatctatgtgaatgggggtagggacaccatgggttctgagatgataccttgaaaggaactgcacacctagtgaattataagccacttctatacacatccacggcaaacccaggtttgccaggcttggaggagccgggcttgaggaccttgcccccctcccttccccagcccacagcaccctctgcccctggcatgccctcagttcctcagacccctgccatccccaggcttccaccacctgtgcagactggccggggattgttccacacgggcttcccatcaggccccaggatgcagctcagggtcgaggtgccctcaacttcgtagcccccgtggcagtagtaggtgacggaggagcccagcttcaggtcggaccccacccgtgtgccgttcttgatggaaccaggatcaaaacatgactcccgcgggttttctgggaaaaagaaatacaaacacgtgcacacacacagagggctcatgaggaggctattcttgggctccagtgcccatgaggagaacccgactttaattagccacagagcacacggggatgcgtgactgtggctcctattcccctcaggtctagaaacgtctctaaatttgggtagaaattgaaggatggaaatcacattgaagagggcaatttcccctcctccccccatgttcttgccttgacccacagaggaaggaggcccagcaaaatcgctgaggccctctctcatcccctgcttgctcctccccaagggaaacatgtgtttctctggctggtgggggctgacagtccctggaccacatctcagctgccggcagggtcactgtggtaaaggtcagtgcttaggtacagcccatcactttactcatctttgaccccccacactcagcagcctcctggccttttgtgttcacctgagaagcagggcagacagtctgcttttggagatgctctttctcttcctctctcttctgccccatctgtaccactggctggggagtagagctggcatctgttctgcaggcccagtcatacccatctgttgcaggttcttctgagtgcatgggtaccaatacttagattcagggaggaagtacaaaactcacttccacctctgggttgggttacccgaccggtgggataagttgatgtctccagtgcagttttccagggctctgcactgggtattgggtgcttgccagtttatgaaaaccacagtatttttttcatgtggctattgacccttacatgtcttccctatcagtcatacagtttatgaataaacagtcctctactctgtcgctctgcatcaaacaagaccactcttgacattgcctgtggcttgagagtactagtccaagtcccaaatctctggagtaggacactctccagcatccctcaccatcagctggaaatcctgagcagcaactgggagcccatgctcacgcttctatgcatgattacctttcctccgtcctccttgttctaagataactgatggtcaagagggttgtcaccagggctgggcagtaacaggatacagctgaggccagtcagtaccagggagatgcaactgagtatcaggttgactgatgagcattttggaggatacattattggggggcaacagagaggtctagagatggggactcacaaaagggtgctgacagtccttgcagaaggactcagaaattcaaagagtggagttaaggagggaagaaccagaatagaagggatcagtgttcattcatcagagatgaatggctcaggaggaattttgctgagggccgtccttgtcacctgggtaccttttagattacctacacaggaggcggccactacttgaggctgtcactcagctgccaatcatctggttgactgatgggatggaactctgagagtctcactattgcacaggagcatgtgagaagatcctgcaccttaagtcgttgcccgcagctgagagtggagcagctctggatgcactactgcatttaaacccaagtgggaccgacaacatggccactcgtcacagggcactcctcagtggtttcctcatgtgccccgtgatgcattgccttgacctcctttatcaaatctgtcttctccatatgcctagtgtctctggccagaatagaactggccactgggtgacccatatgtgagtcatagagatccagggacctgtcatcatgtcttttgtttcatctatcctttttataaattcaaagtgggttaaatcttactaaagttcagaaaaattaagtaacttggaatcaaagttcacacagctcataagaggcaaaactagctgtagtccccaataaccactttccccaccttcatccatcaataacagaactccaattttatccagagcttgaaggcatcagctaaattctacatttcccagcctccttgtgtaaacacgagttagatcatgtctgctgaaaacaatccaatagcctcccgtgtcacttggggtaaaaccaaaatccttacaggccttcaaggccctgcacatgtggccccaatagtcccctctgtgacctcagctcctgtcgtctctatgctagctttgctccaacgacactggcctctggtctttgtggctccctgtcttacctctttcaggacttagctcaatttctccttcagtgacactctttgagcagctacttaaaattgcaatactcctctccccaatgcccccaacaccctcctctgctatatttctctccactgcagttaatactctctcatcgactctatattgaccttatttttttctgtcttcctccactagaatatagatttcagaagggcagctgttcagttttgttcacggccatattccagtgtctgtcacatggtgggcacttaacaaatatcttcagtggattattgtggaacttttaaaaagactgtttaagggaagttgactcagctgagggaaatgcttattggcctttccttccttgcatctttcctccttctctcagtctggaactcagacatgatggctggaacctcagttgccatcttggatcggagataacgttgaaatgggatccatggactagcatggtagagtagggagacaaaagcagccaaggtggagctccctcatcaatcctgggcgctgtcctccagatttcttttataggaagtctgataaatgtctaccttgttcaggcaactgtgtttttgggtaactgctgcaccagcattggaccctagctgggaatgactggcccagaactttacagatgtcagaatgtcctttctttccttatttgtgtggcaaaatcctacacttttaatgccaccttctctctggcagaattctgtttttctttccctggttataacatgtatcacgctattttggtaacttgggtaagggtatttctttccagtaggttctgaactcctggaggagaaggttcatcacctgatcttctcataaccctggcaactagcacagaacttggcaccaaggctagccctatttggcacataatagaggcttaataaatggctgctgaattgtttggctgaatactttgaggcttggaaaatcaacaaccacatcaacgattccaactacagactctattctatatttactcacacgtaagagaaagatgagctcatcatcccaagcattaccacattaataataatgacatggataatgacagtgatgatagccccttacataggaatatcacttcataattttcaaggcactttccaagccgttatctcatttgtgtctcacaataccctctgcagaaggcagggccggttatgctcatgttcagtttatagatgaggaatatggtgatcagagaggccaaatgagtcttccaagcctttcagctatttagaggtagaattaagaccaaaatcaggtctttagtcagccaaaccaaagctcagctgtgaatgataacactaaatgactaaaacatcatggtgattataataaataaaacccaagcccttcaaaatgggaaaatgagaagagccagcttctctctggtcctaatagatgaggcttacttccaaaccttataactgcaaaaatctgaatataacccaaacattcaaccagtaaggaactggttacaaagggtggattagggccatctactgaaacactagcagccttttaaaagaatagcactattctttgaatactgatatgggaaggagtccaagatctattcttgggctcacatacaaaaaaatcagattacagatgagtacatatggtgcaatctcattcatatagaacagggatcagcaaactacagcccacaggtcggtggctgcctggttttgtaaataaagttttactggaacacagccatttgtttacatattgtctgtggctgcctttagcattacgaagcagagctgagcagtggcaacagagaccatctggagtaaaaatacttactctctggccctttccagaaaaagtttgccaactcctgatacagactttacattactttatatttatagaaagtatccgaaatgagataccaagctgttaataatggtattgcacgggatgatggtatttgggggcatgctaagtctttaagagtatatcttatatgcttatatattgtttgaatttttccaacaaacatgcattcctttaaaaggaggcagaatataagatagttctaatttgcatttaagaagaatgacccataacagcagcaggtggtgggaataggggtggtagcaggtgtggccgtagcttccaggcccacagtgttacttccaagggcttgaaagagaaaatacatgctttttaggaccttccattaaaaatcgattcactttggtctttcctgtgttctttcagattctctaacacacacttcaaactcttccctctgaaacgcccctggcccccactctggcacagagggcttctacttaacctttagggctctgtctaaatggatcctgctcagagaggccttcacagcaacccttctgatttgtttctcagaggagcctgttgttttctttcctaacttcttatgcttcttacttcttgctgtttccctcactcacctgtaagttacattagggtagggatgatgattactttgctccctgctgtattctcaacacccagcagagggcatggcatgaagtaggagtcatcaagcatttgttgaatgaatgaatatgtcttgcatgtgcgtggatgtttcagcacattcctgcctaggaaaaggctgccacacatgctggtatatgagaataaaggtccttccaccccactggttctgttgatatccgtggcctggagaaagacataaacctccctgtgactccattttggtaactgtatccaaaacacaggatccctgctgttctttgtttccttttagcaaagggtaaagccacccaggaggatgaattcagaatagaagtgcctctgatcaatggtctaatagaaatccacagatgacatgactgcattcagaatcatctcctagaaagtctgcccagagatgactaagacactacagtcacccttcagaagcaactgaacagagacatctaaaaacccacccctctttgccttagaaccaggtgggcttccaacatctcatctacagaagggtccgtcggtctagttgtcacgaggatgtgaactccatggaggcagagactttgtttggttttctggtctgttctcagcccctgtaagaaggtctggcatatggtagctgctcaattcgtatttaccgaatgaataaataaataaaaatgcctgacctgctcttgccccttctgcaaaagcctaatcccatgatgctgctcagtggacacttgaattaagcctgttccctcagatgatcctttgggatctgaaactggaatctaaactgggaagtgattcaaagccaagagtgatctgggcacggtggctcacaccctgtatcacactttgggaggccaaggtgggtggatcactggaggtcaggagttcaaaaccagcttggccaacatggcgaaaccccatctctactaaaaatacaaaaactagccgggtgtggtgatgcatgcctgtaatcccagctactcaggaggctaaggcaagcgaatcacttgaacctgggaggtggaggttgcagtgagctgagattgcgccactgcactccagcctgggtgacagagtgacactctgtctcaaaaaaaaaaaaaaaaaaaggaaagaaaacaacaacaacaaacaaacaaacaaacaaaaaaagtcaggagtgagacagccacatttatcccaggagaatggaaaagcaaggaaaattgatctgcagggaggggagaatgtagcaagtgctcagaaggaggcagggaggagagagaacgattctggagtgcggatgatggtctcagtctgtgcctctgccatcctgattccagtcctttgggagtttatgctttctgcccttgggctcttgtattctaaaagtattttgcttttttgtgtcagagttattgttatctgtattgttaaaatatagaaaccttttagcttaagttacttaggctgttagttgttttctcataatcatgtctcctttttgtgtcagattgttttgagtgggtttctgtttcttgtgtttttataataagttacccctttgtttgcttaagttgctctgagtggttttttgatatttcctaagattctaccaaactgtttctgcttctcacttgggaagctgtgtgtggagaaaggctcctggtctctctgccttgggtcaggggaagggttaatctcagagagtaatttcccctgtgctgagcccaactgagtccagcaacatctctctatgtggggcgctcgtaggcccctttcacctccctaagcaagacccctgaagccacagctcccaggatacccagactctcagttttagcagagccctggatctctctaaaagacatggacacagatgcttcctggatgcagaggccaattctgcttttcctgaggacccagccctgcctccctgtggaggtcctcagtgggctgcctctccatctatggttctctccagacttacagggtgtggaatgtctaaattctttgctatgggctggcaaagcatatgggacacatacgtctatcacaaatattcatgttataaatatcccacacttattacatgtgcaaaacattatgctcacactttacatcttcagtaaacagaaaagaacatgtaccgtgttcccctgggttagccccattctcccttccaaacaaaggcacaacaaatgcaataccagtgacgtaggaaaaaggaggtgggatgaaagtgggtggatcaaagtacatatcaaatacttattggcactgggcactctgcttgatgctgtgcctatgtgctaatcctcacaacaactccttcgtttagtgtcactgtccctttttcatggatgaggaagcaatgctcagaggagttaggcaacttgtttcagggcatacagttatgaagtgatggagcctaccctataaagaaagatagtgtacatgggaaaatatcctcaaagccatgggacctgatagcaaagtagacccattccaggaatccagggatcctggcataggcagaagcagaccagagggtaaggtaggggtccctaggttccaccaaatgggctactagaccagaggcccagggagatagtagagggtgactaatattaggaggtgtgtagtctgggaatgaaggaaggaaggaaggaaggaaggaaggaaggaaggaaggaaggaacaaatgaaataatgaaggatgcttgaggcttccaacaggcaccccctacccctcaaacacacatagttatctttatcttggtacttgcactacagatcctaatagggtgatgggggatacgtctgtaggatgtgcctctcttctcccctctctccagtaattggctgcttggctggctccgatggcagctggggaggtcttattccccgggttatggtttagacctaaagacccctctagatacccaccttgggtcaacaggcaaaagtggaaagaacttcactgggaaagaggttttgaaagtatggctctcggaccatgaatttccttggagaagacctgggggagagatggccacaggcaggtaggcatgaacaaggtgactggagaggaagctcagggggtttctacccaatagcttactgtatccagggaagctgaaatgaaatcatcttataaaaaatgaggctgacggggtgacatttggggtgaattttggaatctctgccaagaagaactcagttgggtcaagtcggaggcagctctggtggttgctaaggcttggctgggggaaaggacatcactcgtagtgactctaagtatcacgtttgtgcagctttgtctgggtgtcctcagctgtgtgggtgtgggttcaacaaagggtacagttttgcaaggtttatgcacttggaggactagcgggcaggacaattgagggtactgatgagaatatgaaggaagagatgaataataagaaatggtgatgatatggcagtggggatggtggtggtgggagcaatggaggtcccagactgggtctaagttgtggcttctgtttgttagaattccaaagtgtctgactgtgctgatatcagtgtgtggaagagggtttgggcccaggaggtttaccaaatggcaggtgcctggaggaagaaaggatggcagaatatccattgcctaggccagccccgtgaggcaagaagactacaagtaaaacattctccattttgcacaccagtcttctagaactgtacccgacaaacaggagataatcaagaactatgaggagtccaatgagttgatggatatagagcacttaggctggtgctggcagtgggaaaacactaagtttgccattgttctaattagtgttatgtgtgagctcatgtgagatattcccaggggtggccggaaatatttaattaggggacactttaaaaggtatctgaggtcttatgttatgcaagtggggaacatgagccagaaaatttttaattttagctggtaatgcgaccccatttgtatgctcaggctgatgaggcctgggtgaacccgggttatagtaacaataacaaaatctatcattcccagagcatctgtagagtgtttagtacatatggagcattatacacacacacacacacacacacacacacacacacacacacacacacacatatataaaatatgcatgtataaaatatcttttaatcttaacctcctgcaacataattattactagcaacaatttgtagatgatgttccaagagataatacttgtcaagctcacaaatcaagcaaggaagggagctgggatttagataatgggatttgggataattagggaagactaaaaggtcaaaaagagataatagcgtagaagacagtggagtgctcgagagcctggaactcctcttactactactaatgatacttgaacattacagaatgcatgatatgtgccaggcactgtaccaaggactttcatgtgtggactcactgatctttacatttctatgaagcaggaattttcctaccatcgttttataaaggaagaaatggaggcttcaagaggttcaatgctttatccaaggtcacgcaaatgttaagtcataaacatgaactttcaatccaattaatttgacagtcaatgctcttaactgggcagggacagcctgtttttgtaagtgaatttttcttcaaatgcagccacgcccatttctttctgttttgtctgtggctgctttagcactacagtagtagggctgagtagttgtgataggtaaacctacaatatttactatttttaggggaaaaattgttgactcttgctctctaccacaacactactgaacttgccttaattagcacagctggaaggatgagcaaatgtgatcaggaggtatcagaaagtgaccagtctatgacgaggtgtcagagtgtggccaaggagtgtccttgggacagaggtctaagcaccatgaccctaggattagatgggctgtccatagggatgttgaagttacccaggatggtgagaagctctgagtggagaggaagattgtgcctcatatcagaatcctctttagtgaagtggagtgaaggaagataccagctgatagctatgaggttgaaatagagttaggaatgaccctcatagaaaaagagaagaggactagtggttggaaatagatgaggtgcaaaaagaatgctggttcccttttttcccacccctggagaatataggggtgaaagactaagcccagatgggggccgcaggaaaggcaggtttctgcaggcggcagcagtgctagggttggtgtgggcttgctgtggtccagcccagggctctcctcactacgctacactacttgccctctgccttgttagctggacctgtcctcagtactctctggcaccagggcccttacctgtatagtcaatgacgaagccagcattgctcacagatgcatcgctgcggaaggcgaggaagaggctgttgctgctgctttcaatgcggcctgggagctgggagccatagaagcttcctatgagagggctgagagagtcccgtccgtcgtagatatggaggaagtcatagccaggctccaggttaaagctggggaacaaaaacatcccacccccaccccactaaggtcaaataaaggcttttgccggggtcttaggctcaaccaaagcatagggcctcccagggagcaagcccaccatcccactggtacccaacccctgaagactggctggtgggaagggagaagatgaggccctgatgacctcagtcaggtgagaagatggaagaggcaggctcaggggcagaggagtcagattccagtcagtgtctaaaaatctggagctgaaaacctaacgtcctccttatacagaagggaaaatgagttgccaactctggacaccaagctgtcaaccaaagtaggtccaaaacccaactctcttacctgacactaatgtccttatactgtgctcttctgaacctcattttctaagagagaatgagccaactatggtgccattctcagggaggaagggacctgttaccatgaaggaccctagctttgtgccttcatcccaagccagtgctccagctctcctcagggtctgctattgccccacgcctagcacccacaaatgtcctaacccttagctattctgaccctggtatgagagaaaaatccattttaaaaacttagttgagcaaattgaatattagagttcatgaatgtaatttatcccactggaatggctcgagtgaaaatgatggaaaatgcatattacgaaaaaattatgcatggagttcaaaagttttttgcaccaaaataaactcacactaacttgttataacatgtctgcacaggatctaatgtgaggcattaagaaggacaagatatcagcttgaaaaaagcctctatcagagcaacatgaattctgctaaaattgaagcaaggaaaaacattaaatttatggtgaagcttgggtagaagaatggtgacatcactgatgctttacaaaaagtttatggggacaatgacccaaagaaatcagcagtttacaaatggataacttgtttcacgaagggaggggatgataatgaagatgaagcctgccaaggcggacctccacatcagttggagaggaaaaaaattaatcttgtttgtgtcctaattgaataggaccaatgattaatagcactaacgaaagccaacaccatagacatctcgactggttcagattacacaattttgactaaaaaattaaggttgatcaaactttctacttgatgggtgtcaaaaccattgtgcctagatcagctgcagacaaaagcagggcttttggccgggcatggtggctcatgcctgtaatcccagcactttgggaggctgaggtgggcggatcacaaggtccggagatcgagaccatcctgactaacacggtgaaaccccgtctctactaaaaatacaaaaaattagccaggcgtggtggtgggcacctgtagtcccaactactcaggaagctgaggcaggagaatggcatgaacccgggaggtggagtttgcagtcagcagagattgtgccactgtactccagtctgggtgacagagcgagactctgtctcaaaaaaaaaaaaaaaaaagcagagctttcagtggaaatttaaaaaatgtgggatcaagatcctgaaacatttctcccaagaacaggagatggaacatggatttaccagtacaatccggaagacaaagcacaatcaaagcaatggctaccagggaatggaagtgtacagtcaaagcaaaagtggagcaaaggtcaaggtaatgggtttttttcttttttatggatgctccagacattttgtggttgattttctgaagggccaaagaatgataacatctgcttcttaggagtttgttttgagaaagttagctaaagctttagcagtaaagtgcctggaaagcttcgagagagactccttctgcccgacaacaatgctcctgatcatttctctcatccaacaagggtaatttttcaagagtttcaatgggaaatcattaggcatccactttacagtcctgatttggctccttcttattgctttttgttttctaatcttaaaaaaatctttaaagagcacccattttttcttccgttaataaagtaaaaaagactacattgacatggttaaattaccaggaccctctgttctttagggatggacaaaatgactggaatagttggttacaaaagtgtcttgaacttgatggagtttatgttgagtaataaagtttatattttttattttcatcttaaattcaatttttccacaaactttttgaagtcccccctgtatgcctgtgctctggtgcagcaattccactcttaagtatatatctaacaaaggcaattgataccaatcaagtgtgcaaagatgaaaacaatagaaaagtaaatgagcttgcagagaatagatttcagatgcaaatttgctcctgcccagccatggtctgggatactcagatacagcaagtcctcagcattgtccacaggctctcagaaaccatgactttaagtgaaatgacatataacaaaaccaattgtttatttctcatcaacatacaggctgggcacagtggctcatgtctgtaatctcagcactttgggaggccaaggtgggcaggtcacttgaggccaggagtttgagaccagcctggccaaaatggcgaaaccctgtctctactaaaaatacaaaaattagctgggtgtggtggcatgcacctgtaatcccagctactcgggaggctgaggcatgagaattgcttaaactcaggaaggaagggttgcagtgagccaagattgtgccactgtactccagcctgggtgacagaatgaaactttgtctcagaaacaaaacaaaacaaaaacaatataatgaaatgacattgaaggaaacatttgaagacctgctatactttgttttacttaaagtcaacagtttccaagaacctgttgatgatactgaggacttactgtactctatttgagattgagagtaaaatgactgttctaccttttggctaagatatatagcagggggaggaggtcatacatctctaggacaaaggagataaggctggctaagagacaggatgggggactgggaggcacggggcacagagccagatgcgcactggcctccttcccacctggcaccttgtcacactggtgtcagttgcggggtcaacacaccatggctgggtgacacggtcttcttgcccctgtaattcagcttcttgacatctgctcttttgaaagtcaccggcgaagggtttcggagggagtgagtcttggtcacaaatgatggcatcaccacttcctaactaactgccttctttctgtctctcccttccatcatcaaattttgagcaccctcgatattccaggcactgtgcaaggtgccaaggacatggggacatgtaagacaccacttctgccttcaaaaattgatggtgctgtaggaagtgacagatatatcaacaacaaaataatgtatgaagtcagcccgaggcagagcagaaacacaaagcaaggttccttggggaggatgaaaaatcaaacatttatggaggaaatcaagcctgaactgagtcttgggagatgagaagacccttacagataggacaaggagggaacaggaagttgctgtgaaggcagaaacagaggcaaagtcataagggcatgaaagaatccgtgaggccctgaaactgcaaggagttccatctggctggagcttagggcttaggatggggtgggcttaggatggggtggggggctgactggagaggtaggcaagcaccagattgtttggaatgaaactccaaagtttgggcctttattataagcaatagagggccatgataggatttaaaaataaaggatctatttgtttgtttctttgtttttgaattgaggtatgatttacaccgtgtgaaatgatcagccctaaggtgtgccactctatcagttttgacacatgcatatcaagacccagaactgtcccaccaccccagagagttccaaatgccccttcccattcaaccttccctaccctcagatgccaacactgattagaattcttcaccagggattagttttgctgatcctacaattttataggagttgaatcatacattatgtacttttttatgtctgtcttctttcactcagcataatatttttgggactcatccacgttgttgcatgtatcagtagttcattcttttttattgctgagcactgtcattagaggatgttaaaatggaaagtagggtggttatttcagcatttttgagtgacacgatcactctgacagctagctaagggagagatcggcatgggaggcaagatggggcagaggaaccagctaggagatgagggcagtaatttagatgggaaatgataggacttaaaccaggacaggagctaggaggatggagaagaggaaatacatgaggagagtgaaggcgatagaggctgcatgccttggttgctgctagtggaagaagccgtgagagcaggtgtcaatgccagccccaaggctcagaacagagctcttctgggggagaaaaaatatgcttgattttgtacatgctcatttgcagtgtctgcaggccccagacagagatgcccaacatctggatagcgatgctgacgctcagaataaagccagggtgggcagcagaatggagtcttccacttataagaggagagtggagacaggaatgaccgaacttgtccaggaaaggggtgtaggggaagaagaggaggttttgacaaagcccggcaaaagaagatggtttaacaagaggtccacgtgaagtcacagaagagcttggagaactgggaagagtaacttcacacaaaccaagggaaaaagcagtctaaggatggaaagggtgatcaagaggtggagtggataaaacacagaaaggcccattttgtttggaaccaggagttcgtgggtggcttttatcagaggagtttccagtagaaccatggaggcagaaaccaggttccagggggttgagagtgaacgggaggtgaggaagtagagaaaggcagaggcagttcttttgaagagcttttctgtagcaggaatggaaaagcaagtgcaggagctagattggggggggtgcctgggacccaagcccgcctgtttatacctctggagtggggtggaaggggccggggaagcagactgggaatgcagagggcagggcaagggcatccaacaaaggcctcctttccaggtcccagtatcttcagaggtagagaggaaataataattgcttcctcacaaattactacaaggattagatgtgatgatatgcatgagaccactgagcacagtgcttggcacgtagatgttcaataaatgctagtttctctctctctcggcttcttcacctccctggagctgagaactctgctacagacctgtgaatactcacctggagacccaggtcccagagcccctagccactctgaacccttcgtctcccacccgggggaaaggtacatacatgttaaataccagggcgatgacgtagtctggtgagacggtcactttccagtcacactccttgcctggcgggtagggttctgggtaatttggtgagaggatgactccagatggtcctgtcaggtctcccccgcagggagctgaggagagaagaagacgagggtgaggctgcctcttcaccctgggctcattttcatgggtgttgctaatgcactattgagagaggagaggctgaggctgacaggctgaagttgaacctggcttagggactcaggagaaggtgaaatgatggacttctactttggagggtgggaatatttcagagatagtggtggtggttgcgcaacatttcgaaagtaccagatgccactgaactgttcattgaaaaacaggtaattttatgttaggtgcatttcacctcaataaattattattattattttttgagacggagtctcgctctgtcccccagccccaggctggattgcagtagcgcgatctcggctcactgcaagctccgcctcccaggttcacaccattctcctgcctcagcctcccaagcagctgggactacaggcgcccgccaccatgcccacctaatttttttttgtatttttagtagatacagggtttcactgtattagccaggatggtcttgatctcctgaccttgtgatccacccatctcagccttccaaagtcacaggatttcaggcgtgagccaccgcgcccggcctaataaattattctttaaaaatacctgaccctgctacttcctagctgtgtgaactcagggaactcatctagcctctctagccctcgatgtctctcccgtatcataaaaagagacaatatcttctctgtggggtggttgtaaagattattggagatgtctgctgaagtatttggtagagagtgaatggttgatagacggagccggcactgtctgtacacctatgaagtacatggccttccttcactgcctcacatcggcttcccggcaagctttgtgggtactgactgtgagttcccgtgcactcaatgtcaggaggagtgggaaacaggctcacattcgcctgccaagcgcagctggtctcctacgctgccagtgctcctggcatctgctcgcggctgcagatactttccaactttccaaaaggccttgtccaagagtatgtgtgtacctcagttgtatggagctattattaatccccaatcagtctacgtggtcgccctcccctgagatgacaggtctctcaagcaggtggggagggagaaagtggccaggtgacacagcaacctatttacctagggaccttctggggcagcttccccagagcctggatcaggtctcttcctccatggctggggctgctgtaccgtggcatgaggactggatagagtaagagctgggaagcgtgtggggtcgttagcaggatggccaagactataggtatggtttggtctggaaaccacagggcaccatcagaggttgtcaacactgagcccacaggaacacagagagccatttaagggctggctagaaaatccaagatgagtctttgtggggggagcaaaagggtatacctgactccaaagttaggagcagcctttggcttgtcatagagctgagcactggtactttagctgtgtcatggagccacctctggctgtggcttttactcagggtgaggcttaaagggctgggtcaatccctaacagggtctcaaacaaatggtaggtcttcaggtcaggccataagagccctaatgtggctgaacataaaatccgagtggtcatgagtagtctgctttttgttccatgggaaaatatatcccaagaaccatcctgagtatcagaaacactcaaataggcatctattacgtattagacttaacaaatcacattttagatacactatctcatttatgtctcattaacaactcaatgagcaatggattattcttcctgatttataaaggaggaaagtgagtctcagaaagcctaagtaacttgcccagagtcactctgagactcaaactcacatgggactggctccaaagtctgttgttttccccctttctacttccatacagtcggtagcagtagccagagtagaggaggcgtgcttctccccgctggccagcagggagagcacagttgttgcaggagcttctgagcgaggtggtgccttaagttgggtctgcttatgtctcacttgtgtctccaccactgaatccttcaggagcagagggctagataagtggggccaagcagaggccagtacaatcagtctagacccttgagcttaacaaagcaagactgtaatgtccagtccatggagcgtggccttgcccaggccagcctagaaacagagtctgatgtggccagtgagagtggaaagccagtgtcatatcagaagtcccaactctggggaaatcttcccaagggggcacaacgaggcctccattctggttcccagcctccacgtccctttgccagctcaggggcttcttcccttaagtttgccacagatggggtgagtctctgtgtttctgaaactgcccctgttactctcccaccaacccccaaagtactatcagtgtctctgggttctaggctgctgtctgggcacagatctcttctagatagttccatggcatcgggcatgggcttccctggctgctgccagttgtgccccaaggccttgcttggatccctgggctgcctcgccaacaggaaggctcctactgctcagggttagtcgaggggtccttttgagcttactaaaccatggttgcccagatgggagtgggtgcaagctgcagatccttctagacagccaagaagtgggcaggttggactgagggtgagagttgtggaaagggcattgatttggaagtcatacaatcctgagcacaaattctgacaatgccactcattggctgtgtgagtttgggccagctgtccacccctctgagcctctatttcctcatctcgaaagtaaaagaataatgatgataatggcttctaacatacacagtgctaactatgagccaggcacagttcttattgctttatagtattttcttttttaatcctcaaaacaatgctagatggtaagtactaccattttcactattttactggtgaggaaattaaggcacagggaagttgggcaatttgtctaaggccacacagcttgctgtggtgaaggcagacctgagccagggagtggaatcccgagctctaacctcaccacagagtgatttcagctgcaataatgtagctaaaatgtttagcccggtgcctatcacggggacagcatccaatgagtatttgttttcttcctttgcttcctccctgtaatgaagggttatcagggccagctagacccgctcatggcagaacgcccagggagctggaaatcagaagcatgtcactgggatttccagttcatttgagagaagaggcaaaggcatttattctgttgcctgaggaacatttcccaaagccgagtgtagaagaacgggtgatgaaaactgaattaacctctccaccctacccactgcacatttattgctctcctcagcttagcacaatcctccttctccacttgggacaatctcatctcaggacctgcttttctgtaaaataagtctaaggaatcacagccttgcagaaggctgaatttggaaggagcctcagaggttcccagattctctcctgggcctcaacagaattcccttgagcagatggaattctggcttagggaaggggaagggagtctgaagacttgaaagaaggaatcgaagaagggaaggatgaaaagaaggaaggaaggaagatagaaaggaaggaaattagtatttcttgagattggggttaggcgtgtcctcaccccacaatgccataagggaagtgtatttaccctcagagataaggaaactcaggctcagagagttgaagtaatttcccaaggtcaccaaagtagtaaatggcagagctagaaagtaaatctggatgtgtctacttcagtatcccatactgttccctacacagcagaatacgtagtgaagaactcagctggatctgaaacccaggtctcaacctcctgccccacatacctatgcggctcctaattcccactgaggagcaggatttagtgtgtcaacttcagggccaggcctcagagccatgactgtcataggccagtcctcagaggcctgggcagcgtactgcctcccattaagcctgagtgagagaggtgcaggccagggcagacgctcctgcaggagctgtctcaggaagccccttacacccatctccagcaggggaggcagtgtgggaggtaggaaaatgagaggctttgcattcagactggcgtgggtgtaaatcttggctctgccatatcctagctctgtgatttgggacaagatatccaaatttgtctaagtttcagtttcaagtgtaaatgaggaaatggtgctaatttcagagagctgttgggaaagttaaatgaggttatctaagtaaatgtccagtatggggcaagtacacagtaaggactcagtgaccatgggttctcttctcttctaacagccagcattgacaggggagataaacactcattatttcacctgagcaaaatagacatgtggaagtgggcacctggagggtttgtctctatctatttacctttctttcccatcccagcctcccttcaagttccctcctcctctcagtctcaagtagttagaggcaggatttttcaggccccaccctttttaagtgatgggaccttagacaagtctcaggtccttcatgtcttcatctctcatacaggaaggttttaagactgaggacagatctaaagaaacaaaacctgtaatcccagcattttgggaggttaaggcaggaggatcacttgagcccaggagttccagaccagcctgagcaacatagtgagactccatctcaacaacaacaacaaaaatacaaaaatttgctgggtgtggtggcacaggcctgcaagcccagctacttgggaggctgaggtaggagtatcacttgagctcaggaggtcaaggctgcagtgagttgtgatggtgccactgcactccagtctgggcgacagagtgagactctatctctaaaacctaaaagaaccaaaacccaggtaaccaataatttccttgagaacagcaaaagcaaggttcttttctttacattctgaggctgtgggtgcccttctattgcttcaggtaatagaagggtcatttcggaatctgttagcctttattacccaagatgacccactgtcctccttctgacctgtacagcctgggccagagagaaagggacagacctgtctgacttggaaatctctgggacaattttagcaagtgaggaatttgtagtgctctgtgtatagagtgtgaacgtgagtgagtgcgtgtggggacacatgcatgcaaagcagggtaaacaatgggttttctgcaacttttgtctgtttcaattctcttggccccaggcccaagatgcagctgctgtgcatggaaggttctggagcacacaactgtgagccccaagagcagagtgcaccctgcagctgctttgtaccgatgcatgttggcgggctgggctgccagaagaacctgttctcgatcttcacacagctgatctctgcacttccctgcagcgcgtagccagggtcacactggaacactgtggagtcgccggcttcccaactgtcaccactccgactcccattctgcgggatcccagggtcattgcaggacgttgctgtggacactggggcaaggaaatagaagagagggtaaggtcgcctgggtgtctgccactcaggaggctcccagctcatcaccctcactgattgccatcatccgtgcattgccacaaccaccagaacctccccatcatcatcatcagctgtagccacagtgccactattctcactcccattactatcactgcctccaccaccaattgtgatcacacttgtcactctcactgatatcaccactaccattcttccagtaccttcaccattactgtcatctgcctgtcatgagatgctatgagttaagcatgattatactgttataattatagaattgaattcagcttaagaatacaagcattgttacataaacaaagcattgcaattttgtataatgtaactaacatgatcagaaggaggaagtgacaagataattaagtctaaactccatgctgccaggtatggtggctcacgcctataattccagcactttgggaggtcaaggcaggaaggtcacttgaggtcaggagctcgagaccagcctgagcaacacagcaagaccctgaccctacaaaaaaataaaaaagattagctgggtgtggtgatagttgcctgttattctagctactctggaggctgaggtgggaggatcctttaagcccaggaggttaaggctgcagtgagccatgatcatgtcactgcactcgagtgtgggtgacagagtaagagctcatctctaaaacaaacaaacaaataaactccatgtattcaattggaagggtttgcaaaggactttgcgagttggcctgcctaaatgctaagcagtggttgtgaggttaccgggagttactgaagttaggtcaagatcatgctctctcttgcaatggcagacaaccaaggatccattagactgaaaccatatttgaagaaaagtcagatatttgtagcaagtgggcagagaagaattcaaaaatagctgagatatattaaaaattcaaaatactcaggaatttgcgacgtcttcgtgtctattacctaacctagtttaacatagagcaggtgttttataagcgaatactgaatgaatgctagatggaaggaatacataaataggagaatgagtgggtgaataaatgaacaaatgtggcatgagaaaacacaccggaggaatgggtgcaagagttagtccagagaaaggaatctcaagagctggaacaaccctggctgcctccacagcccagagctgacagcggggcccggtcccagtccccagctatgtcatccctcatagcctgtgctcagggcactctagggcaaggaggttcttgaaaccacaggataaataatactgatttgattggaatatcagttttctcaacaatttaaggaaaaactacttttatactaaaacaaaagaatttattctggattacaaggtaaaattcatattagtttttaagcaaaaatgtgaagccttaaagatattttgtgcttgctacagccaccagacatcctgaggatgcacacccattctcttctgctatcaggaggacatcagcggaaaagtttgagaagcggcagcctagggcaactgtatacactgatgtcactaattataacctctgggattgtatacgagtcttgagttacacaatctgataccttctactcaataacacctaaggaagcatacagcaaactatggcccacggccatatctgggcctatgcctatttttgtaaataaagttttactggaacacaggcacactcatttgtttacatatcaacatttgacagctactgaacttatttgtaaagtcaaatatgcatcaatctttttccttcccagttaaaatcagacttagctttcatctctagctttatagggcactgtacacatgtaaatgttcccctagaagaaaaatagctcattgttctggccatacttggaaggattatttatatgggaggcaatagagtacaatgattagcagcttaggtttaagaaacagacacatggtttttgctattaactagatgaccttgtatgagaagcctcggagcccacatctgcaacatggagtaataatggtgcccatactgtaagggttttgtgaaaattgtaagagctgatgtagtggagagcttagtgtggcagccactcaataggaatggctgtgattatgcttcccgctcacctttttttttgttctcactttctctctttaatgctcctgaattggagctgcttggcaaagcacccggggaaaggctggatccacgtggtacagacaggatgttagatgttacacagtcatgtttacttaataaagccaagcctgcactaatcgtccctggcatttctgtacaatcccctgtcaaatacacactataaagttaacatggggtgagccgttctctcttccctagagtagtcctggtatttgctaactgatgacagcaacagggaaggtgacctttcccaaaccttggttatgcccataacactgggccaggctgtcatgacctttctggagcccaggctaggtagctttgaccatgctactctgcctaagcaatgctaagggcagcttgcccaaggaaacccttctgttagagaaaaccatccattcatgtgttcatatcttcatgtgcccatttgctcactaagctgtgagtgagcacctgctgcatacatacactatgagagagtcgggaggcatggcatgaccctgtcttctaagagcttttagtgggatgtcaagtaggtgcccagcttcaagacgagacagaatgcctggtattgaataaatagaagtaaagtgccagggtgccgtgggctatagcagttttactctgaatggggagattaggaggcagtggcatctgagatgaaccttgaaggatgaataggacttccatgagctgggcaatgcatgagaaagcagcctgcatacagcataggagagcacccagggactctgtcccgcgtggctacactgagtatgcagtcgaggtcagataatgcaaatctgtgggtgaatttgtcagcataattatgggctttttcttttcttttaagccgcacccatcagcttgggcgcagttggagaaaatatgtctggctttaattattcataatacttctttccccagagagtggatcgagccgtctctttagcattctaccctccttactgctgggagatccttccattgcttattccagcaacttcccaagtttgttccacgaaatgttagtctcttgagatggccttgaaaaaagtcatccatgatggaatatgtttggaaattgtggcctaccagacatcttttgaatttaagggcattagcatagcaaacgttctcagaggccccatattgcagatcatttccttgggtctgcatcagcctgagcacctccccagcatcacttgatcatgcaaacttcttttttcttgcaatatcaattagtattccatggaactcttaggaatagatggaaaatgctagactagaagcatgcatgagtgttaaatggacaaatttataagtataaagcaatgtgatcctggagactctcatctgctccccacgctgctaaatgcttatttccacagagatgacagacgtagcagaaaagagctagaagcaggatttgcaactctgtaacaatctcagtggtgccagggatataccccaaccacccttagctgatacaccaactgggaaagagctcgggggcaaagccacggcacaggtgccacaagaaattgctctggaatcaccatggaaactccccccctccctcccaccacacacacagtggagtaaggagatggtaatgaagacagctgctgtataataaacacgagcagaaaccgaagcagagtcacttgatcagggggaggaatgatggaagaggcacttcagaggagatgagatgatgcattccagggagaggcaggaccaatcatataaattatctcatactgggatttggatgtttgagcattggccattttgggtagctctttgtcatgctcctccataattggctattgcagtgcctaattaattaaatttagatgactcatgttcacttccagtctttgctgagatctgcactcaactaagaacctgagcgtgcagcatgtcccatcagcttattcataaccatgccccaagccaccgtctacttgtacctcccacatccctccttgctccctgtgcttcagccacatggggtagccctccacttccaaagcccacattcctgcatctacacttgttcatgtgttctttgcacctaggatgcccttttctctcttttccatctaataggggtgcacaagtcctccaaagtccatttcagtggcacctttccttgtcatagatgactacttgctccttgaaacactttcttttcttgagtaacttctacttgtccgttgggtctgagcttggacatcatcttttctggaacatcttccttgatgctccaaggtgaccattatggaccgtatgtctccatccagatgcttacctatttgtatgtgtctattaacccacctgtcttccctaccagagtgagctcagcacagacatttgaacaggtgctaaccatgtaccaggcacatagcagatgttcaataactatctttacatggactgagggatgaaggaaagtgagggccagaggaaggtgggtgccatgtgtcaggacatgtggagtggggctggcagagggcacgcacagacctgaaaattgaatggcaaagccctgcttgctggtgaagaagtcagtgctgaactgcaggacgaccgagttgaaggtgctatgcaggtccttgggcagggccgggccactcagctccttcagcagaaccccgctctccacaggcccatcccagatgcgcagcacgtcgtgaacctcctctgtgtcaaacaccaggaagtgtagcctgcacggagagaagaggcagtggtcatctggactcagcccttctttccaggggcttctggtcagaaggtcctaaacctacgaagactggccctaaacctacaaagccctaaacctccgaagcccagcaggaggggagagaaggcagcgtctggcagcatcctcatttcaccaggccagctcctcccactggggcctccagcaatggggacaagggtgcgaggtgtaggttttgtgcatccttttcttattatgagctccatgttgccattgtcagactgcatccctctcctcaaccttacatagcccgcagacctctccctgagcccatattgttaccattctaggttggaaggggaatactgagaaggcaggatctggcttggacaaaggatataggtaaaaaaaaaaaaataattggggctagagggcagggggaactgtggagtctctgagaagctggcccagccatggtgcaggtaggggtgacctcataccttgctttcccagagcagaattctggggatattagctatatgtaggcctggcttagataatctctgcagacctcaggaggccaggtgggagtctccctgtgtgggggtctgcaggacagagatagagctctcagagcaagggagctcaagtagtaacctgaatttttctggaaccaaagattccaacagccaaagataccttggctacaagcctgtgtgactctctctgttaattaattttttttattattgtggaataattttagacttacagaaaagttgcaaagacaatacggtgttcccatagacctttcaccatttcttctattgctaacatcttacatttccacggtgcatttgtcacgactaagaaagcaatgttggcatacttactatgaactacactccagactttatttgaatttcaccagtttctccactgatgtctttttttgtgttccaggatccaatccatttatcactatctctttttaaaaatatctttttaaattttaaaaataagacatactcaaggcagagaaaaggcaaacaatatacagatgtactgaattttaaaaaagtctctctttcacacagccaacctgttctccagagctattcaattaatagtaggtttggtacatatgcttccagagtttttttcaatgagcacgcaaatatattgttccctcaaaatgagacatattttatgtagttttctataactttctttcttcatttaatactatatcatggacaaaaacatcaccctcatttttctgcagaaatggacattgttatataacacaatttcacatgaaattgcaaggaacatttgcatctttatgtagctttgtgcatttctgctaatatttcagttgacttgccaaagtaattctaggggaagaagggcatctatttaaaaattttaggccaggagcggtggctcatgcctgtaatcccagcactttgggaggctgaggtcaggaggtcaggatcacgaggtcaggagatcaagatcatcctaacacagtgaaaccccgtctttactaaaaatacaaaaaattagccgggcgaggtggcgggcgcctgtagtcccagctacttgggaggctgaggcaggagaatgtaatgaacccgggaggtggagcttgcagtgagccaagattgcaccactgcactccagcctgggcgacacagcgagactccgtctcaaaaataaataaataaataaataaaaagaaaataaaataaataaaaattttaaaataaatcttgctaaattatcctctcaagtgattgtttcaatttatattcgcactaatcagtattgatgttactattctctctaaagttcacctcatcagcattagatattataatgttgtaaatatattctttacgaaaatactcccccatctgctagaccacagtggaatctctctggcagttttgagtttagatgatttagtaaggttgggtatctctgcacatatttactgggcatttgtagctttcaaattctttatccatcttaattgatggatgcaaacttttgaaattctacttatatattatgacttttatttaccttatatttttgatttctcttttatatgatatatttgttgctaatcttttctcctagtgtctggtgactttttctcatttaactttggtttgtggtatccattttggtaagaagtgattaattttatgtaaccaaatacgttaatattttcctttaaggatactggatgtcatgttatgcttgggcagacctctccccgacccaacgattcaaaaacaaaacaaaactttaatcaaaactttaatactttcctgggacttgtatagtttctttcttctctcttttttttttttttttttttttttttgcgacagggcctatctggttgcccaggttggagttcagtggtgcaatcgtaactcactacaacctcctgagtagctgggaccacagttaacatgccaccatgtttgactaattttattttttgtagggatggggtttttctgtgttgctcaggctggtcttgaatgctgggattcaagcaatcctcctgcctcagcctccaaaattcctgggattacaggtgtgagccactgcacctggctagtttcattttttgaggctaacaagttcattactcttccaaattgacactcaattctcccaacacctatctaaagtagcctcttccacactttgcctaccaaaacatctgtttactccctccgtagcatctaccagtctatctttagtgtacctatttgtagactatgcttctccctaactagatcataattttcatgagtgtggaaccaggccttgtttgcctaagatgtatctgacattttggatggtgctcatgatacccatggatgatgacacgctcatagctgaagaatcctgattctccctactgatttgaaatatccccttagttgcgggctgtttctggactcttctctcaagtccagtgatctctcctttccctatactagaatctacttgtggtaccaggaacgtagctactcaccttacttgggtttccatattctcaaattttgattttttccctaaaacttactaatttcccaaatttactcttttagataaactttatggttaccaagtcccaaaaaaatgtgattgagattttgattgggattatatacacattgattaatttggagataattgatatctttatgttactaattttccccagccaggaacattgtagataacttagtttatgtactttgcaaagttttatgtttttcatctttgttatggttttcttctttgcacacctcttgttaaatttcctctttggcagtccacaagtttatggttttggttctattgtgaatgagatttaatgtttagttacattttctagttatttattgtcagatatatatatgtgtgtgtgtgtgtgtgtgtgtgtgtttcttactttcggtcactagttagtactattagaaaccaacagaatctcttggatttcctaggtagaatcttttatagatataggaggggattccttaaaaccaggacctgtgtaaggctggggccccacatttgatttgaaaagaggagaaggagatccctaggacagagcacaaacacacatactcactgctgtgccaggctgccccctgccttctctgctttctctgtggtgatcaatgcactgtgaaatcagcagccaagaggagaccgagtgccagccgtgtggtgtggctgtacgtgctctcagaaaagacatcggtgtgggccacactcatcagggaaggcaaaaggaaatgagacctgaagtttaggtggcgtgaaaggagagtgctttctttggatttaataacatgagataagacctggaggcagagaggaggtgaagctgtccgggaagaaaggcaactccatacttgagttcaggtggtattaggatgccatagagaatacagctgattgagagagggaagagaatgagtctcaaaattagctatgggagtttgggctttattgtattctagttagagactgactctagaggccatgtgaaatcctgagggtgaacaactgaatgaatgagtgagtgaatcaatgaatgaacgaatgaaaccccagtctgacacgaagctgagaaaagcaagaatatggggactaaatagacatgaaggaaaacgtgtttccataacaaccactgtgtataaggcactttcacattagcccatggagtccatgcaagcatctttattttgtagctaggactagtctcatctttaacaatgagaatactgaggctctgagagggtaggtaacttgcacaaggtcatgggctggttagacagtaagctggaattgctattatttaatactaatccaggtcagaccttagtgcttctactctctcctaacaatgctgcccacatctctgggaggaagaggctgtggttgagagctaggcaggggctggagaggctctatcaatcatcaacagtttatatgtgagtcatacgtaagctgatatgaattaaaaatgccagttgattgcattcggcttagctgatctgataaacagacaaagtcaaaggcttggcattgatgttgcggagaggagtgcagaagaagggaggagaaggcggggttctctgtgtgcacgaacaatacaagttggcaacggaaaggacagaggctaaagttcaagcccctttcggcactcattcacttaagcgcctcccatatgcggggtgctgctgtataacagtgaagatgacagacagggtgccattctccgggagcttctggagatgggcaataaccccccagacacaaactcactaaaaaattatcagctgtgtctagcacagggcaggacatggcagagtgctgaggcagagcatccactttagacagagtggccggagaagaccttctaaggaagtggcatttaagcaagatgccaagccacatggagagcaggaggggtgagaggtgggaggaagcctgcagtgaataaaggagagcatgtgcaaaggtcacaatggaaaggccatggaggcgacactgggccaggagaggtaggcaggggcagggctggcgggactccgtggatggggggagatgtttggtgtgtactataggagctgagggaagtcattggtatattttaagctgagctctgacaggttccgatttacattttgcgatcactcttggtgcctgggtaagaaaagattgacaagggcaagagtggatgcagggaaattagctaggggctgccacagggggccagtgaccccttttattataaacctttgatgatggccagtaaagacttggtttgccaacccaaccacatttattaagactcttattgaatacttatcttatagaaatcagagtctataaatgctaatgagcagttctgatcgacagagataattccaggccaaaacagccattgtggtttgtgtgagcagctcccctgtaggtgaacactgggtcttcttctggcttttgatatcctgagaacagtttgcagctcccctccccattgtactgtgcccctaggtaggagaaactgaagtggaggaaagaggtgaaaagatcttccttcctattgatgacttgcttgtctgtgtgtgcgtttctttggaccacaaacacaaaacaggccatttccagggaagagaaatgaagcatgttgcatgtcaagctctgtgttgagagctgcagaaatgtgcaaggctctgtgcttgccctggaggaaacttactgaaggagacacccaaaacataataatatgtgcaataggtgctaaagagtggaataaataagatgctatcaaaataaccggaggacaaaaagagctaaacgtttgtagaaaatctcccatgtgccaactgctttatgtacattgctgaatatcctcataaagccctgcagttgagagtgtattctcactattttgctgtggaggaactgaagttccaagggattaacagaggcaactagcaagggtcagagacggtattcaaaccatgtctgtctggtaccaaaggcctttcttttacaccatcttctttttcttttaatttgaagaggcaaggaaagcttcaaggaggcagtgtctttgaaacagttttgaagaaaggaaagtgtggagaaattgagggagagaaagatggcaaaagagggaaaagcaaattaagaggaatcgaaagagtaactggccttcctggatccagttcccctcccatcctttcaatccaccttttccatcaggaccacgtctatctttctgaaccactcctctgacccagtctctcctccttctctacaggataaagtcagacttccgaggggacacaccaagtcccccctgggcttccccagttgccttctcccattcttctaaccctttactgatttccttcttattctcttgcttcagagccttctctctgcctggaagttccccctgcaaatggccccatgccacttgtagcgggttgacttgtgtcccccaaaaggatatgctcaagtccttacccctggtacctgtgtgactgtgaccttatttggaaatagaatcagatgtaatcaagttatgacaagaagggcatactggattagggtgggccgtaaatccaatgactgatatcgtaagagaaaagagagggagatttggatacagagacacaggagagacacagggaaggagaccatgtgatggaggcacagatagaagtaatgtgtctgcaacacaaggaatgcgaagggttcctggcaaccaccagaagctatgagacacatgagacagattcttccccagtatttccagagggatcttggcccattgagaacatgattttggacttctagcctctagaactgtgaacaaaacacatttctgttattttaagctattcagtttgttacagcagccctagtaaattcttctaccccctgactgatgtgtactggtaggtgcctcacatccagtggggagcttttccacaggcttctccttgtcctccccatcccctcagtctagtgagatgctccctctacaggctcctgctctatcagagtcatccattgacttccctgtcttgctgaatcccttaactcttgtgccagtgtctcattcacttctatatctctggtacccagcatgaggcctgacctgtactagccccttggtgaatgttgtctgactgaattgatgaatgaacgaatggctcaccagctttcagggacccctgtggttcatccaaactcacccactgtccttgccaagcatctgtcactctacaagaggcaacttaaacaaatcctatatactaaggaggatacttcctatttctctggaagttctgagctcttcctttaccatccacatctagcccctcggatcttacagctgtatctttggtgctctacactaccaaagacatagaatctagccacacagaacctgggccagagctcactgctgaatctaaatctgggagaaactgggatactgcaaccatggtctcacacttttaaaatccagccctgtaggttccctgagcctacagtgatactgatagtcatactttaaatctataaatagtaagtactaggttcagatagcatactaggcactggtgattcagataagaatatggcatgcttccacccctgcatgtggtacagtctacagtaaaggtatgtacggagaagccccctaacttaggccaagggtatgagaccaggcctcctgggagaggtaactactgagctgagtcttgatatctttataagagaaaagagagatgagagattaacaggatgagtccagatgaagggggtgggtgaggagggtgagaaggggacagaatgcaggcagagaaaatagggtatgcaaagacacagaggggatgtagaggctggcccacccaggaaatgacaagctcttcaggaagacaaagcatgaaatgcgggtggctgagacctgaagccgtggctcagggaatggtgataatgtccaagctgcagaggagtgaggaattcatggtccccattctcctagtgagagcagtttccttggtgctggggcagggctgagggcagtgagggaggggttccaccaaaggagggcttttgagttggtctcatcatcctaagtctggtatctggtttgcctaggttgcatcttgggcactcatgataatctgcagtctaactccagcaagtatgccagctcaggtaactgggtctcactgggcccctggttctccctcccattccttggtggggctgccctgaaattctgcttgctctgcgggggctggatcttgacttcattgctggctgcagggacaccctgggatgtgcagataaccctgttcaagtctgagatctccacatgcctttcctcaaagtgttttcagagttccacctcccactgccacacccacgcccccaccaaccaatagcaggccctagctaagggtggacccacctggccctcactcccgtacctcttcccaccagccccctctgagactccactgtgctttgctgaggctagtgtaaggttcacaacactcagcttcagcaacaggagattttctaccagagcctaaatctaagaagctgggaggacagtggattttcactgcaggggcccgtccctctcaagtgctgcccacaggcaaaacttgcttctgagatcacggtcctcagttcttttactctgaaggaaacttggacacactaggtattttttaaaaacaaaaacaaaaacaaacaaacaaatgattcccacctccctgcttataggcagtttatctctatcccattgcaaattggaaagacatgcaaaggggggtggagccaagatggccaaataggaacagccccagtctacagctcccagcatgagtgatgcagaagacgggtgatttctgcatttccaactgaggtaccgggttcatctcactggggagtgccggacagtgggtgcagtgcaccgtgtgtgagccgaagcagggcgaggcatcgcctcacctgggaagcacaaggggtcaggaaattccctttcctagtcaaagaaaggggtgacagacggcacctggaaaatcgggtcactcccaccctaatactgcgcttttccaatgggcttaacaaacggcacaccaggagattatattccgcacctggctcggagggtcctacgcccacggagccttgctagcacagcagtctgagatcaaactgcaaggcggcagcaaggctgggggaggggcgcctgccattgcccaggcttgagtaggtaaacaaagcagctgggaagctcgaactggatggagcccaccacagctcaaggagccctgcctgcctctataggctccacccctgggggcagggcacagacaatcaaaaggcggcagtaacctctgcagacttaaatgtccctgtctgacagctatgaagagagtagtggttctcccagcacgcagcttgagatctgagaatgggcagactgccgcctcaagtgggtccctgacccccgagtagcctaactgggaggcaacccccagtaggggcggactgacacctcacacggctgggtactcctctgagataaaacttccagaggaacgatcaggcagcagcatttgcagttcaccaatatctgctgttctgcagccaccgctgctgatacccaggcaaacagggtctggagtggacctccagcaaactccaacagacctgcagctgagggtcctgactgttagaaggaaaactaacaaacagaaaggacatccacaccaaaaccccatctgtacgtcaccatcatcaaagaccaaaggtagataaaaccacaaagatggggaaaaaacagagcagaaaaaccagaagctctaaaaatcagagtgcctctcctcctccaaaggaacgcagctcctcaccagcaatggaacaaagctggacggagaatgactttgacgagttgagagaagaaggcttcagaagatcaaactactccaagctaaaggaggaaggttgaaccaatggcaaagaagttaaaaaccttgaaaaaaattagacgaatggctaactagaataaccaattcagagaagtccttaaaggacctgatggtgctgaaaaccacggcacgagaactacgtgacgaatgcacaagcctcagtagctgatgcgttcaactgtaagaaagggtatcagcgatggaagacgaaatgaatgaaatgaagcgagaagagaagtttagagaaaaaagaataaaaagaaatgaacaaagcttccaagaaatatgggactatgtgaaaagaccaaatctacgtctgatcggtgtacctgaaagtgacggggagaatggaaccaagttggaaaacactctgcaggatatgatccaggagaacttccccaatctagcaaggcaggccaacattcaaattcaggaaatacagagagcaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagctgacctctcggcagaaactctgcaagccagaagagagtggggaccaatattcaacattcttaaagaaaagaattttcaacccagaatttcatatccagccaaactagcttcataagtgaaggagaaatgaaatcctttacagacaagcaaatgctgagagattttgtcaccaccaggcctgccctaaaagagctcctgaaggaagcactaaacatggaaaggaacaactggtaacagccgctgcaaaacatgccaaattgtaaagaccatcaaggctaggaagaaactgcatcaactaacgagcaaaataaccagctaacatcatcatgacaggatcaaattcacacataacaatattaaccttaaatgtatatgggctaaatgctccaattaaaagacacagactggcaaattggatagagtcaagacctatcagtgtgctgtattcaggaaacctatctcacgtgcagagacacacataagctcaaaataaagggatgaaggaagatctaccaagcaaatggaaaacaaaaaaaggcaggggttgcaatcctagtctctgataaaacagactttgaaccaacaaagaacaaaagagacaaagaaggccattacataatggtaaagggatcaattcaacaagaggagctaactatcctaaatatatatgcacccaatacaggagcacccagattcataaagcaagtcctgagtgacctacaaagagacttagactctcacacaataataatgggagactttaacaccccactgtcaacattagacagatcaacaagacagaaagttaacaaggatatccaggaattgaactcagctctgcaccaagcagacctaatagacatcttcagaactctccaccccaaatcaacagaatatacattcttttcagcaccacaccacacctattccaaaatggatcacatagttggaagtaaagaactcctcagcaaatgtaaaagaacagaaattataacaaactatctctcagaccacagtgcaatcaaactagaactcagggttaagaaactcactcaaaaccgctcaactacatggaaactgaacaatctgctcctgaatgactactgggtacataacgaaatgaaggcagaaaaaaagatgttctttgaaaccaatgagaacaaagacacaacataccagaatctctgggacacattcaaagcagtgtgtagagggaaatttatagcactaaatgcccacaagagaaagcaggaaagatccaaaattgacatcctaacatcacaattaaaagaactagagaaggaagagcaaacacattcaaaagctagcagaaggcaagaaataactaagatcagggcagaactgaaggaaatagagacacaaaaaacccttcaaaaaatcaatgaatccaggagctagttttttgaaaagatcaacaaaattgatagactgctagcaagactaataaagaagaaaagagagaagaatcaaatagatgcaataaaaaatgataaaggggatatcaccaccgatcccacagaaatacaaactaccatcagagaatactacaaacacctctatgcaaataaactagaaaatctagaaaaaatggataaattcctacaaacatacaccctcccaagactaaaccaggaagaagttgaatctctgaatagaccaataacaggctctgaaattgaggcaataattaatagcttaccaaccaaaaaagtccaggaccagatggattcacagccgaattctaccagaggtacaaggagaagctggtaccattacttctgaaactattccaatcaacagaaaaagagggaatcctccctaactcattttatgaggccagcatcattctgataccaaagcctggcagagacacaacaaaaaaagagaattttagaccaatatccttgatgaacattgatgcaaaaatccacaataaaatactggcaaaccgaatccagcagcacatcaaaaagcttatgcaccatgatcaagtgggcttcatccctgggatgcaagactggttcaacatacgcaaatcaataaacataatccagcatataaacagaaccaaagacaaaaaccagatgattatctcaatagatgcagaaaaggcctttgacaaaattcaacaactcttcatgctaaaaactctcaataaattaggtattgatgggacgtatctcaaaataataagagctatttatgacaaacccaaagccaatgtcatactgaatggataaaaactggaagcattccctttgaaaactggcacaagacagggatgccctctctcaccactcctattcaacatagtgttggaagttctggcctgggcaatcaggcaggagaaggaaataaagggtattcaattaggaaaagaggaaataaaattgtccctgtttgcagatgacatgattgtatatctagaaaaccccatcatctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaattgcttcaaagtgagtaaaatagctaggaatccaacttacaagggatgtgaaggacctcttcaaggagaactacaaaccactgctcaaggaaataaaagaggatacaaagaaaagaaagaacattccatgctcatgggtaggaagaatcaatattgtgaaaatggccatactgcccaacgtaatttatagattcaatgccatccccattaagctaccaatgactttcttcacagaattggaaaaaactactttaaagttcatatggcatcaaaaaagagcccgcatcaccaagtcaatcctaagccaaaagaacaaagctggaggcatcacactacctgacttcaaactatactacaaggctacagtaaccaaaacagcatggtactggtaccaaaacagagatatagaccaatagaacagaacagagccctcagaaataatgccacatatttacaaccacctgatctttgacaaacctgagaaaaacaagcaatggggaaaggattccctatttaataaatggtgctgggaaaactggctagccatatgtagaaagctgaaactggatcacttccttacaccttatacaaaaattaattcaagatggattaaagacttacatgttagacctaaaaccataaaaaccctagaagaaaacctaggcaataccatgcaggacataggcatgggcaaggacttcatctctaaaacaccaaaagcaatgggaacaaaagccaaaattgacaaatgggatctaattaaactaaagagcttctgcacagcaaaagaaacgaacatcagagtgaacaggcaacctacagaatgggagaaaattttggcaacctactcatctgacaaagggctaacatccagaatctacagtgaactcaaacaaatttacaagaaaaaaacaaacaaccccatcaaaaagtgggcaacggatatgaacagatacttctcaaaagaagacatttatgcagtcaaaaaacacatgaaaaaatgctcatcatcactggccatcagagaaatgcaaatcaaaaccacaatgagataccatctcacaccagttagaatggcaatcattaagtcaggaaacaacaggtgctggagaggatgtggagaaataggaacacttttacactgttggtgggactgtaaactagttcaaccattgtggaagtcagtgtggcgattcctcagggatctagaactagaaataccatttgattcagccattccattactgggtatatgcccaaaggattataaatcatgcagctataaagacacatgcacatgtatgtttatggcggcactattcacaatagcaaagacttggaaccaacccagatgtccaacaatgatagactggattaagaaaatgtggcacatatacaccatggaatactatgcagccataaaaaatggtgagttcatgtcctttgtagggacatggatgaagctgggaaccatcattctcagcaaactatcacaaggacaaaaaaccaaacaccgcatgttctcactcacaggtgggaattgaacaatgagaacacgtggacacaggaaggggaacatcacacactggggactattgtggggtggggggaggggggagggatagcattaggagatatacctaatgctaaatgatgagttaatgcgtgcagcacaccaacatggcacatgtatacatatgtaacaaacctgcacgttctgcacatataccctaaaacttaaagtataataataataaaattaaaaaaaaaagagcgtggctcctccccgacttctcttgctcattctcttgccatgtgacatgctcgctcccccttctctatccaccatgagtagaagcttactgaggccctcaccaaaaggagatgctggcaccatgcttcttgtacagcttgtagaaccatgagccaaataaacctcttttctttataaattaaaaaaaaaaaaaaagaaagaaagacatgcaaaaatgagaaaataaaaaaaattcatggcaccttgacctgttgatttcacttgccttctgactgggccccagaatatgaaagggctttggatgttcccaaccaacagtcaccactgcaggaacacaataaacccatcgctgatgtgagtcatgatggtggatctttacattaggggaaaatggcatgtgaatgaacagctgctgcagggggaagggggtcagaaatcactcctgtccccacatgagaatgcagctgcaattatccttggtgacatcggaaagggcaataagaaaataatacttgttttatcaaatgcccccctctaagctgaccgagctgcaaaccaacaattaaaccatgatcataatagcagacaataataattaagtatcacgctatccaaagagcaaaaactgagaagacagaccaaagcccaaatccagcattggtgtctatagcaaaataaaaggctcttctcttcagggaccagctggcatgcaaaagaaataaaagattctttggttattttctaaagtggaaaaataaaactgggcttcaggtcactgaaaacgttgcagaatgttccagggtagtgactgctgtcttggacttaagctgtgaccttgtgcttccctctaacgtgctgggtgacctccggccagctgccctctcttcctcatcaccctgtcactggaggctctgagactgcctatcactagacagagtccagagtctgccctgtaggtgtcagggattctgtgaggggccaatgtatctttgtccttggaagaaatgtttccataaagtcaaaacactggctgtggaaccaaagacctgggttcaaattgcagttgtttttttttttttttttttttgagatagagtcttgctctgtcaccaggttggagtgcagtggtgccatcttggctcactgcaatctccgccccctgggttcaagcgattctcctgcctcagcctttcaagtagctgggattacaggctcatgccaccacatccagctaatttttgtatttatagtagagatggggtttcaccatgttggccaggatggtctcaatctcctgacctcgtgatccacccacctcggtctcccaaagtgttgggattacaggcgtgagccactgcgcccagcctcaaatactagttctgagagagctaacttggtgaccttgcagagcctcaatttacccccgtgtaaaatggctgtaatttcaatctatcaagcagcgttgctaagagtattatcataaatgaaatcacatagaaagcatctagcacatagtattaaataatcatcaaatggtaaaatcacctaaaataattccatttttgttcaatttattttattttttacttgactaagagagatgtgctaaagtctcctataaggattgtcaatttctcctcatatttctgacagattttgctttatgttttctcattaggttacttagtgcagattcatgactgttagcattattgtggactatgcattttatcatatgaaagcattccctgtgtctcttttaatgttatttaaccttgaattttactttttttttttttctttttgagatggagtcttgctctgtcacccaggctggagtgcagtggcacaatctcagctcactgcaagctctgcctcccgggttcaagccattctcctgtctcagcctcccgagtagctggggctacaggtgcccgccaccacgcctggctaattttttatttttatttttagtagagacggggtttcaccgtgttagccaggatggcctcgccttttttttttttttttttttttttaacagaaaagcaatattgtgatccctgctttttacttccatgtgttctcatgctattcttttgtcccaaccttttatttttaatattttgttgttcttctgtttagcagcattcttttaaattttatccaacccaagaatctttgccttgcaatatgaatgtttcccatgtgggcaccagctcatagctctttacggctcctgctttccctgccacaggtcagtcagtagttactctacacatcacggtagaggcttcctttccctgtgcaccgtcgtcttggggcctctctctgggatcctgtgtttgctccctttgcagaccctttgctcagcatctgagtcttgcactccgcccaggcacctgactttagctctttgctgatccttcagagaagcctcagacggtagcacttctgtgctctgggccttatatccggtcagcctctcagtctcctgcccatcctgagctcctgtaaccttgatctgctccagaggctgcctcctctccccccattctcttttccctacatgaggcctggagccttgaattactttgtggaacagacacctccagccccacccaggaccctgttccccactgcagactagcactggactgtgaagtgtgtgaaaaattaacctttattgtgttaaaccactgagatttgggggttatctgttatatcagttagccattactgttgactaataatacaagcttatttccatcatcctgttttatgcttttttttttttttttttttttttgagacagaatctcactctggcacccaggctggagtacagtggcatgatctaagcccactataagctccgcctcctgtgttcaagtgattctcatgcctcagcctcctgaatagctgggactacaggtgcatgccaccatgcctggctaatttttctatttttagtaagatggggtttagctgggttgaccatgctggtctcgaactcctggcctcaagtgattcacctccctcagcctcccaaagtgctgggattacaggcatgagacaccacgcctggctgtgttttatgcttttgtttattatattttcttgcttttttgggtaatattccttagtttgtaagttttctttagtgatttgcaaagtacacattttattttaaattctatgggtggttttctttaagcattttcaaaagtactcctaaacttgtattttctctaatcatcaaatttaagaaaaataatatattataccattttacttcttcttatgtaagacagtaaatcttaaaaaggtttcacctttccctatgccctctcccaaccatcaaaccattgacaatataagtagggactagaggcccaagttacacacaatctttcatagtcaccaattcttagtaccgtgtagtttttctaaacatctcagttggctaaaaattgtatgtctgtattagcttcctgtggatgctgtaacatattacaacaaacttggtggcttaaaacactagaaatttggccaggcatgatggctcatgcctgtaatcccagcactttgggaggccgaggcaggtagatcacctgaggtcaggagttctagaccagcctggcaaacatgatgaaaccctgtctctactaaaagtacaaaaattagccaggtgtggtggcaggtgcctttaaccccaggtacttgggaggctgaggtcggagaatcacttgaacccgggaggtggagtttgcagtgagctgaaatcgcaccactgcactccagcctgggcaacagagcgagactccaaatcaaacaaacaaacaaacataaacaaaaccagaaatttattctttcatagttctggaggccagatgtctgaaatcagtattgctgcgcttcaatcaatgtgtcagtagggccatgctccctctggaagctccagaatagactctgttcctgcctcttccaatttctgatgctgctggcattcgttggcttatggctatatcactctaacctctacctctgtctttgaatcaccttctcctctacgtgtataaaatctccctctgtcttcttcttacaaagttgcatgtggtggcatctagggttcacccagataatccaggataaccccttcatttcaaaatccttaatttaatcacacctgcagagaccctttatccaaataaggcaatatttacaggttccacgcattggaacctcacatttttgggggccaccattcaacctactacaatgtttttgtaagttcctcaggaagccgatgagagccaattttatgtggcttttgtgcatatctgaggataatatgttacctttgtaagtgaatcatatttcctggctgaatcaacaattcttgaggccaatagcaccactgactttggactttggtattatggaaaagaaaaggagtcttaggagggttggattagttgtggtggttttgtaaatgaatattttatagaatgagggatgactatgtacttgcctgtgtgagtcggttttgccaaatgcttgtagggattttttataattcatcctgagctcctatacccttggtctgctctagaggttgcctctgcctccccctttcccttctacctcacccaaggtctagagccccgaattactttgtggagtaagcactcccaccccttggaacgatttcatttttcatcacgttgtatctaatttattttttccctggaaattcaacgactcctttcacttcactgagcacattttagccttggtcaacccactccccaccttttccccaggggaggtgatggccttttgtatattattattccttctgctcagtttcattgctcttctgcatttgtgcttcctggattggcactttgtcttccatgtttgtctacttttcattacttagagtctagcttgtctactacttcaatgcttttatttcttacaaggcaaatgctgctattgtggattttagttgttgctgtgtgtttaatttcttcgcattcctttcttaccttaatcactgtctgtctatttcagaatctctcctcctgcatttcatcatccatcttctattgatcatgcatatttcttatatttaaatgagattattatgtctatatccatttaaattttcatgtctattatagtaaaacatgtttagaaaaaaattttgtatttttttagggagatggttctcttttaatgagtggtatgttttaagtggcatcatacaagtttattttatgtactttttgcttatttctttacttatttttggaaagggagagatctatactggttcagtgtggtcaacccacagggaacgtgcatttctttggttgaatagtttattttcctcctaagagatgttggaattcagttttgggatcttaaactggcagtcaagttgatgcattctggccaattcaactactcagtgtagctcggttagattatcgtatgaggataatttgaagtagtttgtgtttctttctctagaggtgttctatgaaaaactgaatggccggagagtgccaccattctcaaagcttcatttataccttccaggctatccacatcctctccttcaaaaaatgtgtacattccttttggctattctccaatttgttgaagacttaaatctgacaaaggaataccccactgtgtgtgtgcttctctgttcagttcctttaggagatcagctcttgcagtgtaagtacacgaaccttctctgtttaaggtttaacttgctataattgctcagaaataaaccctctggaagctgctgaacctgtggccatgattcctggcaagagctgtgaatgcaagcttcacttctggtgccttctgcctcctctgggccagctgcccacttgctggctggagggaggcaacactgaccactgtggggagttgctgccctgtgactgatctgaaacgacagcaagggaatccaggcttcaggcacaaccagatgtttttctagcccagcatcctcccaggaagataagctccactgggcaggggtcctggttaatcaaaaccatgcccgccaatgcctgctgcatggtgaccaaaatccaagaatggagttttcagttttccctgtgtgttaatcattaagaagtatccctgaagttaaaaaacaaggactattagccaaatatgagctttatgggcatagcagaaatccgagtgtccagagtgagaagttctccaccttccatgggtcccagatctctgcagggaaagcacatcggcagaggactgtctcctctcccttcttccttccccctccacgaagccagacaaccgtagcttcaacccgaaccacatttgcgcataagaaatgactcagttcttttgaatataaccaggatccctcaacagtgctcctaggctcctccctggcttcccagccaatttatcctctgcactgctgccacagatcttcctgaagtcctcatatcccccctagacaatgagctcttccagaagcagctgtgtacattcatatcttcctccctttcacatgcctgggagggcctcacctccaccctgcatggtgagctcctactgttctttaaagtgcagctggaaaggtgcttcctccctgtagtccacccccaactgccatacagaattatgatctgtcctcgcagacacttttctattgtgtttcgtgcatacttccactatagcattcatcacattatcttagaatctatagcagaaactgtgggttggatgatctgtgcttcatttccaaacctctcatctctctactattgaggctctaaaagcaaagcaaaattgatttcccactttttccctgccaggcatggcaagttctgactaatgagatgtaggacagtatctctaaggatagtggttcttcccaaatacacaagcaaactttcatcaggagagagctccgtgccctttcctcttccctcttcttttagactggaacacagacataatgtctggagctgcggcagccaactaggtagccacgaggatgaaagcctcaggatggcagaccaagaaggaaggttatggcttcctgagcagcggtaccaagtctggatgggaccttcagattcttgttccaggagaaaaatgaacccccatctgttgaagccagctttagtccgtttttctattttcattcctaactgatataatttctgtctataatactgagaccttcaaggggaaaagctgtttcttatttatatttatacccccgtgcctggcagaatgcccagcactgagtaaatgctccaagtttttaaattgaactgaatgttgttactgtctttaaagtgttccaacagctccttattatactgagaaatccattcagagttcttgtcttggccttcagtgtgtaaagactcctccttacccacacagccttatttgcccacatgcacgcagctccagccacgtcaagtgagtgccctttcgtggccagatcctgtattttcccctatgttcatacctttgctctcttacccctagctggaaagattgcctctacagtcccaggcagaactcctctctctcttctctgttactgaactccgtcacttggcttgcacttatagcatctattttatcttggaggtacctgtctgtttgactatttccccactagaatgtgaactcttggcagacaaggcctggccttggtctggactttgtgtttccgactgcacagcatcacacagtctctggcacagagcaggtaatcattgcatattttgttagatggaatcagaccacagcctgaatggcagatgggaaagagcaaagactgacattagacggaacatgttccaatcccacattactgggtaattgtcagatctcaaggaaggtcattcattctttctgggcctcgatgatctcatctataaaatggggacagtaataactgattcagaacctggtgtgctataggtatttgatgaatgttttagaggggcagaaccaagagcaaagggctttccctccctttcttttccagttttcatctgagctcgcccactgattattaaaaacaaaacaaaacaaaaccctccagctcaacaccagaagctgagaagagtttccactcctataggatgaaacttctgtgttctatgtactgatgacacaggcaagggtgacagggagggagcagctcatgggtctgccctcctgctgtcagctgccaggcctggatggagtgcattggctcatccaccccattcttggcacttaggaagaagcacttgccagatgctgtaggtattaccagggttcaaggaaaggggctgccttccattccactcttgtcacacacatccaggcaggacccattttccagcttggaccacacccaagggtaagcctgactgtagattcctgcagccaactactttgcctcttgggcactcctgggaagggaccatccttgcccagcttgctggagcaaacctggctacagatccctctggtcaccctcagtgctggatcagggctgaagcagggtagggagatgcatctgcaagccttctcctgtctgtgcccctggaaatagcctcatcggctagcctgctgcctagcccatgtcccttcccacctagcacacatgctcccacccacagtacagcacccaccacctgagatcctttaggggtgacttacagcctgctgtgcttaggaatactctgtttgggtaaaatgaacaactatccacctagctccaggtgggagttctcatcatttgggaattacaagccagccacattctaggtgctttatatatgttcactcaatcttcatagcaaccttaaggagggtaccctctttaattaccatcttaaacataagagaactgaggcacagagggcttaaagagttccctgagcaacacagcaaataagagttcaggtaggctggtaccagagtccagcgcttagctatgacttgatagtgaataaacaataaaactcatgggacataaagaatccagctgaataatcaaaccaaatggctcaagtgcaaaatgcagttgacacagggaaaaactgacaaccattgtaaaacaaaacacaaatagtattctcagggatacaagatgataacatattgataaaaacaaaagtaggctgtcaagagcagtctagaaacagaaaattagtttccttgaaataaaaacaaaagcaagatttccaaaacaaaaagagggtaaagaacaggataattactgttgagaactgaattaatgaaaacacaagatcactggcaaaataaaaacaggatatagaactctgaaatcactagaacaaaaagccaattaaagcagatcagctaacaacaggaagagttaacaataaaaaaaagcaatatagaagcataatgtattctgtttgaaagaaagcataatacattttatgtaaaagaaatatagccccttgtactcatttcatattcttcaatgcccatggaacataaataaaacaaaaagtttgaaaagtaaaaaaaggcacaatgcagtcaaaataaaaataatgaaaagcatacaagatctataaaccacttagtaactgaaaaaattcttaaatattattggatttaagagaaacctaaatgagttatagactagaaatgagcccagttgaacactctatatgaaaaagacaaattgtccaaacagaaaacacacaaagaaccagaaacagcaaagacaattaaatatcctattgtccatctaagcggtgaagactgaaagtattgacaatgtctagtgatactgcgtggggtagcaggccttcccatagacttctggtagacttgtaaattgctataatatctagaagaaaatttgaggtcatgtatcaaaatttacctcctaaaaatatatcctaaggaaataaatggacaactgttcgaagattcaggaataagaatgttggagtgaaaagctgaaaagattcacttattcaacaggggaatagttaaataaattatggtggtacatacaatagaattctctgtacccatcaaacaggatgaggtaggtctatagacattgacatgatgagatggtgacatatgattaagaggtaaaacagaaaacaagctactaagccatgcatgtggatgaacttggtttagaaacatgtgcattacatttgctttatgtacatattggcacacaaaatatccaaaagaataagtagagcagacagacattaatagttattttatgtggggtgtgaggaggagtaagattacagagtaagattgtggaaacgtttcatttcgagtttataaatttgtttaaattttgaattttaaaaaaatgattatctggctgggcacagtggctcacacctgtaatcccagcactttgggaggctgaggcaggagaatcacttgaggccaggagttcgagaccagcctggctaacatggtgaaaccctgtctctacaaaaattagccaggcgtgatggcgcttgcctgtaatcccagctacttgggaggctgaggcatgagaactgcttgaacctggaaggtaggggttgcagtgagctgagacagtgccactgtattccagtctgggcaatagaacaagactgtccaaccctcctccaaaaaaaagagtacctaatttgtatatagaaaaattctataaagatatttctaataaaaaagataataactaaataaggactcaaacacaaaggggctttttgtgtttgtctaattatgagtgtgagttatcctaactttgctgctggttattcaagacaggtgtgtgtgtgtgttgggggttgaggcggagggagaggagaaaaagagagagagggagggaaggagaggaagagagggagtgggaaagaaggagggaaggagaggaggagagggagagagggagtgggaaagaagaagggaaggggagagaaagggggaggacggagtgagcacacataaatacagctgtacgtgtgcatgctatgcatactggctgggatggcagactggggtgggagaatgaggaagggacagtgtcttgccactctatctccatctttctgcagctctcagtgaaactgggaagacatcttcttacttcacattagctcctttgaggttgctgtggctccaagaagccatccagactaaggactgatgttatctttaccttctttggacctttactttcttcttcccattttgggatcctcagcatgccccccatgacttcatatttcttgctatgttactctggagaggacgtttcctgtattggttttgatcttgtcttcctgagggctagaaaggcgcctcctgtctcccctccacccccatagccaccattctcatcagtgaaaatggtcctcactactgcccagaaatccattcatcagtttattgtaatttccttgtgccagccacacctagatctgctctgctctccttaattcccagagaattaatgctgtgccttttaggtacattacggccgctatgccatggatgaacacatccttctctttagacgatgtgtgccaaagcatctagaaatgaagtatcatgatgttgacagtgtactttccagcagctcagcaaaaaggaaaacaaaaggatggaaagagaagaacaaagaaagcacataagcatatatggcaaaatagtaacgccatttgggtgtaggcggtaggtacgcgggtacttggtgtattgttgtcacaaacagtagttgagaaaagttggtgtgatcacttgaatgtcccctgaattttctcttcttctccatctccactgccactgcctgacttctggcctcctcgtccccagccacactctggaggcagcttcctcactgcgcttaccggcccagcccgtcccactccgcccattctcctccaaactgccaggagctgtcaaaacgcagcctcatagccccaacgccctctgtgctccccacagcctccaccaccagcttcatctcccatgaatgccgccacccaccaaatcgcaggtgatcatccagctgcgggaaccatttccagctccttgaggctgaccacactgcttcactctgcctagaggcccattaccctcccacccaccttcctccttggctacctggcaacctcctctccttccttcaggactcagctctagggtcaccttttccagaataacttctcccatctcctcctgtcctgctttttcattccccttcctcattgtgccaccaccttgttctggacagacatgtgcgtctgctctttgtgaaccatggccacatctcattcatttatataatgccagcatctggcacaggcacaaccaggtagtaaacaaacagatatttgtgaatatgagggaatgaatgcatcaatgaatgatgctccaagtgaagaaagtgggaaaacctcttgatttgcacatgtgtatactaaagtgaaatagtcattatgttctcgatccactcattgttcaaccactagtcaccgaggaactatcatagatccactaggcatataactacctttatacttgggtcttgcttcattcattctttcattcatcaaacacttgacacttgttgagccgggggcactgtgctaagagctgggagacttgcaaagatgaatcaggcagagaccacagctccaggaggggaggtaaggcatgagcataaataaaggagaaaagtggtcagtgtcatcaggaaaatatatgcaacaggtaatggaagttcaaaagaggcagaaaggactcctaggagccccgcaagagagggggtgagggatgacctcccgggtgagctgacatttgcacttgactttgagggatggataattttagatgtaagcctttggagggaggagggcgttccagaggaagggcagagtagaaacaaaggccctgagctaggccctgagctaggccatgtacaggggtcaccaataattttgctttgccggaatgtcattgaagagaagtggaaaataaggttggggagggaggctgaagtcgctgtagcctcaaaggccagaataaaatgtttagcttttattctgtgagcgtggggtggccatggaatccggtttctgatcagagggtgaattgatcaggtatgctttcagaaggttatcccagcagtgccgtgcaggatgaatgtgcatatttaacttgttccctaacaatgcaaagtccctatgtacactgctgaccttattttcctcagagtttagctaaaaaatttgtacatattaaatacttaatacatttccttaacattaattgaactgtgtacataagtgaatatctatatttcttgcagcaaaacacccattcagccagttcttcttaattggaaactcttacatgcaggaatcttctcctagctatacttctattccttttcttggctcctcactattccaaatccttagcacttacttcctggatcattgtaacagactcctgatggtgtctccccatgagctctctacactgcaaataaccctggtggaccgacgctgctcaagaaccttccatggctccctcttagttactggcatttaagatggtccataaccaggctatactttacccctatctatctcccattccttacccatgtgtttcccctactccagccagactgtttcccccccaattcccttgttctatcctcctttcatacctccgctcatactgctaccccaacctgctcttttcctcctaactcacctgagccatggctcaaggccccgttttgccagcagtgcaatagtgtgaagattcagaaagacctgggttcggatctcagagttttgattccctgtgcaaacttagaaatgctatgcatcctcttggaatctgagttttctcatctataaaatgggaattacaataatgcctatttgttattagggcttactattattatcaatagggctattgcagggagttaataaggtaggctctgtgttcagtaaatggtgatggttctttctcctctgactccttgaaattccaataaggaatgcctggaaggaagttacattttgatggcatacctattttgaaggaatttatcttttgaagaagtacataccactgctggtcttttgctatttacttcctccacaactctaaaatacaagcatttctgtcctcattttaaagatgaggaaacagcctaaaaaagggaagcaatctgccaggggccatacagctaaagctgagttagtgcttgctaactgtcagaaataaccacagcaactgttattaaatatttcactatgttccaaatactatactgagcatattacatgcaatatctcattcaagtgctttatcctgagatccacactctacagaagaggacaatgagatgcagagaggataaggaactttcccaaagtcctgcaaacagtacatggaagggttggattcaaatgggggtctgcatgccttcaatccatgccctcggctactctgctgtaactgtgctatctgggccagtgaggtgtatggacttggcatgaagccctgagaggctgagactgacctttctagattttctaaggcatccagtatagcaaccactattgatcacaaggttctccaggtgaggcaggcaggccaggcactagctggatggcctggtgatgatgctgatgatggctcccctgaacaactggcgatagttactttgtcagccctgacacttacccaatggtgcagccggcctctgcttcgatggtccagatgcagttgagattgtgttcatagggagctggatacccgggtgacagcacctgccccgacacctctcctctcactgtccctccacactcggctgaaagaaatcccaaaagagtgagcttcatggggtggcctgagctgccagcagtcactcagtggctccttttgcctgtttgctcttgagtcccttccctctcccattcatttcaagtgattgagcacagcatattaaaaggtctctggatgagacttatatccagaacctataaagaacccctacaaatcaacaataaaaagacaagtaacccaatttataaaaggcaaaggattcgaataaacatttctccaaagaggatatataaatagccaatacatacatgaaaagatgtttaacattgttagtcattagggaaatacaaatcaaactcacaatgagatatcacttcacacccactgggatgtctatagtcaaaaagactatacaagcgtaggtggggagtggagaaactggaactctcatcattattgatggaaatgtaaaatggtgcagctgctttcaaaaacaagttggtggttcctcaaaatgttaaacatagtcaccatatgacctagcaattctgctcttaggcatatacccaagataaatgaaaacatgttcacataaaaacttgaacatgaatgttcatagcaacgttattcatagttatcaaaaagtggaaacaacccaaatgtctatcaactgatgaatgaataaacaaaatgtggcatagccatacaatggaatagtattcaaccataaaaaggaatcaaggcggccgggcatggtggctcatccctgtaatctcagcattttgtggggctgaggtgggtggcttacctgcggtcgggagtttcagatcagcctgaccaacatggagaaaccccatctctactaaaaatacaaaaaattagccaggcgtggtggtacatgcctgtaatcccagctactcaggaggctgaggtaggagaatcacttgaacccaggaggtggaggttgtggtgaaccgagatcgcaccattgcactccagcctgggcaacaaatgcgaaactccatctcaaaacaataacaacaacaacaacaacaacaaggaatcaaggcttgctacatgctacaatatagatgaacgctgaaaacattagttaagtgaaggaagtcagacacattgtgcgattccacttatgtgaaatacctagaataggcaaatcttggagacagaaggtacgttagtggttgccagggcctggggaaggggacaacggggagtggctgttaatgggcatgggttttctcttgtgggggacaaaatgttcaaaaattagattgtggtgatggctgtacaagcctgtgagtatactactcacatggttaggctttgtgtccctacccaaatttcgtcttgaattgtaatccccagatattgagggaggaacctggtgggaggtgactggatcatggggccagttttccccatactgttctcatgatagtgagtgagctctcacgagatctgatggttttataagttccatcagaacttatgaagttcctccttctctcacttttctctctcctgctgccttgtaaagaaggtgcctgcttccccttccgccatgattgtatgtttcctgaggcttccccagccatgaggaactgtgagtcaattaagcctcttttctttacaaattacctagtctcaggtagtatctttacagcagtgtgagaacagactaatataactacaaacaactgaattgtacactggtaaataaaaatggtccctgagtgtagggctgattgcctgttctgtgaccaacctcctcaaagcctcctagggaggaacatgcaagtacttcaacctgcttcttgatagcaacaggacctctgctggctgccaggacagcagagatcaacaggatactgccctcccctggaagagtttactgtctagtagagaagacagccacactgtgtgctaggtatcctaacaacaagtagcagcagaagtgaccaatctccctgagcaaaggacagcgagggtcagggagggtgctggtcttaaatgaaccttgaaggagaagcaagagttgaccaggtcggttgggtggcaagggtaggatgggaaggagggcactgcagagagagacagaagagtaactgcaaagttcctggaggtgaggaacagcatggcaggctggaggctggggtatgagatagggagatgggggagatgggactggaaaggtgaggaagcatcacaggttgaaggaccttggataccaggctgtcatatattcactgttccaggaaagaattgcagtgattatacatgtgagttaattgactgcatgacacatcagtgaactttgcatgttaggaggagtcactgtggtggcagtatgatggggtacagcaggggtgaaactggaggcagggaggcaggtgaagaggtctacattccccattggagcagtcactgaagtcagaagctgggggttcctgctggtgttctcctccttcctccccgacatctaatctgcctctgagacccagtcgctaaacctgtgtggtattattcatgtttgactctactttgcccacattgctggagtcttgactcaggccctcacaatctctaggctggcagagttgcccacgctctaggcagtgccatcaacggatctttatcaaatgcaaacaagtcactgcttgcattcactccccaaatgaagtctaaacttttcagtagagcccactgagcccaccagagtggctccctttggcctccgtgaactctttggtctaggctgatgaagtccacaagctctatttggatggaggacctgaataaacatcctcgctgtgacatcttttgtgacatacctcccctccccaggtagaactgacactgccctcctttgtgtctgcattacaatgtgaatagatttctactatagcatgtgtaacatgttattaaaatcatgtctatttcctccacaagactaagagctccttggcagcagggaccttgtcttatatctgcacatcaagtacctagtatactgtttggcacattatagatgcttaacgtttattgaattaatggatggctggacaatcaaatgaatggaagcagattattgctttccatgcaaattactataagcgtctgaatcaagggagaatgagtacaaatgaagaggaggatgttcattgcagagctatttaggaaaaggaatagttgattaggcaagatgctagaaataggagaagaagggatcagggtcacagatggaagactgacccctacctgttgctataaaggacacatcaaacatttcatggacccgttggtttcacacaggaccactaaggaagggttgcaggagaggccctctacaagaccctctgctcaagcttcactcttctctccaaggtgctgttggggtgggaggtgccaacctgattgaaagatgccaggctgaatggacccatggcagggagtagggtgctggtgagaggatggactacaattgtggggaggaggcttgactggttccacaaatagaggaagtagctagaaaggtgggagggcattatccatgtccttggttagagcttccttccatattccagacagagaaggacctcctgcttcctgggaagtgaggatttggaggcagcagcactgggaacatgtcatcatggacaactagataccttacctggggcctggcaggtgggcaggagggggctgagtgggccagcatgtagcagattcaacaacattgagaacatgtaagtctactctttctggtcttctcccttcttcccacccttgagtcttggctgctttgtttgggctgcagagtccactcaccgaagaataaaacatttggatgttttaagctatagcagtcatttgtggtagaccatgatgaagtcgaccacaacatgacatatacaaaaatatgcacataatctcaaatacacagcctcaatcccctagcaggctagaggcagtctcaatggggaaggcctccaaggttctagtgtaagtctaagtttaaatgctcttatactgcttgagtgaacccaataagtccagtccaactggcatatttgatattcaaagtaatcttacagtgaatcttttctgcaaagcaaataattatcttgtaatacgagtcatcatccctccttttcattttgtgtgctctggcttgcttgtctgtggcattatacggttgtgtgtttatgcaagcatcacccttcctggcctgagatctgctcttctctgtattcctagtgcctagcatagttcctggcacatgaatgaggggagatataaaaagagatggagggcgaaaggggagatatgcctgaagaccaggtcaaaggcaaagggagaggaagaccctagaggttccataaaggctactgtttcggtctgtccacttgcagagggtccacttagaccctccattgtataacagtgttaaagatcctgtgaaaatgtagtcgtctaggggaaaagcatctgtggcctttaacacttcccaccatgctggttcacactttcacccttgcacgtgctcagtctagaatgtcaacctcccttcctctccctcctgttggtgaattctaatccattcttccaagtctcaattgaaatatcacctcccatgcaaaacattctcatatcctcccaacattttgcacttaactctttttacagtgcttctcttacattatacttatctgtttatgtgtctattctccatgctggagtatgggccctgacaagggcagtgaacaggttttattcttcatttatttctctgcctccacaaatacccagacatacatgtgcaccaattttggcatgtggggcttggtaggcatgtatgtgtttttccagtggaggttttgttcttacaagattagccagtgctggcacagacacgttgaggttgtgggacatggggaagggggtggagagagagacagatctggttttggaaaggtaggaggcaggacgaagcagtatgggggaactcacattagcagggagatgggtggtaagagatgaaaaggccaaacagaacaaccaattttgcctattttgcacttctgcctcagatcactgtctcttgtcctgtgacacatgtgtaaagattctagagaacctctgatgacattctggaagaatcacaggtttaagaagatgcaagttcattattgcattctttatcagtgagagcaatgggtgttctttatcttactatgtcttttgacattcctccagtaaagggagaatgagccccattttacctatagggaaactgagacctaaagtgggtgggagactcatttgagtcttggcgttacgataagccctggaactcaggcaaaagccccatctctccctttctaatggactctcccacctcatcgctatcacccgcgttacaattttgagggcatgacttggctgtggtcccacttgctaaatgtgcgacaaaggcaagccacccgcctgactgcactgctgcatgggtgtaatgaggtgtgaaagtgaggaagtggagaaggggtgcaggtgaaccatgatgcctgttaacaagaggattcagtccaagttgatggcccccaggccctggagcatggggtctaactggaatgagaccaggactagagcttggtattatgggagacccaagggttccctgcagaggaagagccctcctaccgacacaggtgggcagaggccggtcccaggtccggcgctctccactcagacacagcagctcctcactaccccgcaggctgtatccagggtcacagctgaaggacacggagctccctgcaaaatgaccttcatcatgaaccttgtagccaaacttgggggttcctgggtcctcacatttgatgagttcaaagcctggtgaggagagaagaggtagagtgagtaagacctattgtggcagaaaccatgcttcctctcttccctcaaagcccacgtcctcaaggaagctgtctcagccacggaccctgggttctgatggattcaccagtcaggatttcctcatttctatgctcagttgagggtatattaaggaacatccatttctctgttgctatatgtaaatgatttctgcttttaatagttttcaggcctaaggtctgcattttctatttcttttgtttgaccccgtagcatttttgctagcaggagcgttcttttcattttgcttattgagacattctgataagatggtgtaatatggagaagtcactttaaatgtatgtttaaaagctgagttatgacctgcttaaacatacgctgttgaaatgggctggaaaaggaaacagatttatgcagagctcccactctacggcgctatacatgtgttctctctcatttgttattcacaggagtcttacaggtgggtataattatctgcattttacaacggagagcattgatttgggaaggttaaataaattgttccaaacttacacaattttcacatgatagaagtggaattcaaaggtgtctctaatcctcttccactgaacctcttgctgtaacaggcaaggatcctctgccaggcagccttgagcccagacgaggggaaacctgactatactccgtgcatgattttccccaatagctttctttattgagatacaattcacataccatacattctcccacctaatgtgtacaatccaatgtcttttagtagattcagagttgtacagctattgccataatcagttctagaacatttttatcacctcaaaaagaagttccatacacatttttcccccaactccctcagccctaggcaactgccctttactttctggctctatggatttgcctgttctggacagttcatatgatggagctcaaacaatatgtggcctttgagactggattctttcacttactgcaatcttttcaagggtcatccatgtcaaagcatgtatactttactccatttttttttttctttttttagacagtcttgctctgtcacccaggctagagtgcagtggcgcaatctcggctcactgcaacctctgccttccgggttcaagcaattctcctgcctcagcctcccaagtagctgggattacaggcacccgccaccacgcccagctaatttttgtagttttagtagagatggggtttcaccatcttggccaggctggtcttgaactcctgacctcgtgatccacccgccttggcctcccaaagtgctgggattataggcatgaaccactgtgcccggccacttcactcctttttatggacaaatgctattccattgtatgaacatatcacattttgtttacccatgcatccactgatggatacatattggattttaaaacagtcttaagagcacattctttgtatctcgtgagcaagcagaagctcaaataaatgaataaaatgggaaaccctgacttccttgtccacacagatgcaagaaagacttactggaaaagtgcagttcaaagcccttgctggtgttttcagcatcagtgatgaaatcaagccacagactgctggatgtgctgttcaaagtcacccccatcatctcagaatggctaaaaactcccagcaaacgggcggagttgttgttgccatcataaacctggacacaggagagacccccaacccaatgtcgtcagcatggccttatgttgaacaacacctccttaccccacaacccacactcctggagtttagcactggtaacaactatcagaggcacagtgagttatcagatgcaaggaagatggcagagggaagctatcaactgagcaagttatctcgttttcccttgatgtcagttctatgctcagcccatctttagtgtgaatctagtctttgggaactcattgctattctaatctttccagtggagatttgttcttgttcccgcaatgcccatatagcaccagcttactctttagcagcctggggaggccaggtttgggttgcctgcttgtcaaaccatctgtttcttcagagagacaggctgaaagcattcatctctacattgctaaaccctcaatcctgtccttccagtagatgagacagccatcctctcacctgatcccaccccactgtggcagtagcctgtcttgagcactctgctggacatcatccctgggatccagacaccagcatgtcatggtgactttttcttccccaagctcagcctctgccccttccctcctaaaatgagggctccagctagggcctgctgggcttgccaagggtggaatcgtacaggcatctggcttccctcactcccatctgtcccctgaacttcttagtaccagcaaagacaacaatcatcagaataatgaactggctccccaggtttcaaggttgctgctcctttccagataattgtacaaataacaacagaagttgtgattgagtgaaagaccccctggtgcttttgtaaatatcaaagatgggatctctgagtgggtgatgaatatttgtgcatggcacacaatgtgatgccagctgccagcaaattggcacaatatttccattgtactatttatgaagcaaagctttctaaaagaagccatccttcaaactaacagtgttgtatattacagagatttgtttaggctcctgggagcctgaagtctgtttccagatccttgtgtaattgctgtgtatcactgatagactgagtgaattctggggttccaacagacatcaagataatacaagttcaaagagtttagcttaaattgttacaaaaatatttttaatcaccgaaacatatggaaatcaatggaccaaggcatttatcatcaatggactaggaatcatcaattgcaataagaaataataatcatcaattgcagtaagaaagacaatcagacaccatgtgtttctttaataaaagatataccatcacccatggagttatcttgcccaaaaaatcagacctgatcagatcaagccactggatccaatttccaacttacaggcaataaataccgaggacagaggaacatacgaaatgataccctgtgagtgcattcagcaaaatccagagtggaaagttccactgaacaaatgatctgatttcctcaacaagtaagttacaagggggaaaagaaaagagatggagggagaaacctacagattaaaaaacacatcagacaatgaatctaatgtgtggaccttattgaatcctgattcaaataaactataaatttaaaaaatattatgacatctatgagataattggaaatttaaaccctcactggatatatgatgctattaagaaattatggttaattaataaaaagtatgatgggaacaggatattttccttaatttccaagcataattcatcctaattcatcaagaacaaaaatgttacttgcatcattacaatattaattgcagaaaaacttataaaacagaaatgtgcaaataactttcagaacttacaacatgttggtaagtgtccttctagcctttattctatgcatttatttccttgcataaatttatgtttttataattttttataacaataagatcgaattatagatactatagggcaaactgctctttcacttaatataatgtgtatatttttaaagtcattaaatattttttccataacagcatttaaatggtggcaggaatttctataataaaaattaacccaatctgcaagataattatttacatatcagcgcccaaaatatatgctctggcacataaggctcactcagtaaatgtatgataaataaaccaatattttcctctagaattcatgtcgttaaatctacctggaatttattttgggatatgatatacaattctaccttaactccctgatagattagtcatttaaccaaactctgtttgtaaatattccacacactactaatttcaaatcagtctttatcacatatataattaacatataattatatacatttggttttgtttgtcaactttctattctattgcatttgtctatttgtctattcctgtgcatgacccacactgttttagctactgtagctttacaatatatttaaataattagtaggaaaagtcctcatttgtcttcttttaacttaaacaaaattctcccagatgtactcttctaaactcaagaattttcctgaattataaaaagtaaaacaaaaaactccccaacaaaacttgtgtaattctgactgagctacattaaatgtatagacggatttgagaaaaatctatctatgtgatattgagtcttccaatccatatacatggtgtctagctccatttaatcaaaatgtcttttatgtctctcactaccattctgttcttattcctgggtatttttatatttttgattgctattgggaattgggcctttgtatacatttatttcctaacagaatattgcttgatggtccaattcatcattatgtgcaggtgattgagaaatccaagagaatctatgcacatccattacatccaataaagcaggtcagcaagatggctggtttcaaaatgaatatgctaagcagaaagctttctatacacaattacaaacaatgtaagcataatttctatgaatattcctgcatgtccgcttgcacacgtgtgcttgagtttctctagagcatacatctagcatggaaaagctggttgtggggatgacacatcttcaatttggttagatattaccagattgctctttgaaaaggaatagcaatttgctctctcaccagcaacgtctgacagctttcattgctttatatccttgctgatacttggtattttagggcattatgatgttttccaatttgatgagtgtaaagtggtatctcactttaatatgtaaatccttgatcgccattgaagttgagcatctttttatgtttatcaacagttcttacttccttttctgtgaattgcctgccttttcataccctctgtgcatccatgagaatgaaatctccctgcatttattttagttacatcaatatcaaaataaaattttatcttctctcagttaagatcatgcacattttggagggcttatttctaggtgtcttacagtttttgtttctattataaatgagactttccctcctgattgcaagttttatttggttatagaaacaccagaagctttgtgaattttcttattgattttgagtttattagttgattgttttgtatttttgaaacaaaagtcacaattttctatattcctttctaatttttatagttcctttttttctttttctggtataaatgtaatggtttgtctcttcagtacaatgctgcgttctattggtgatagtagaactattgatcttgttcttgactttactgaaaatctttaggaagttttgccattaagtataatgtttgctataggcatttggtagaaatatttttatcaagttaggaaagttctatttgtagttttatgagatgttttcaaaaatcatgagtgggtgttgaacttaatcacatgatgttttggggtgtattagcaggataatgtctttttctttgctaatctgtttataggctattaggttgagccatgaaattgccaatattttaacagttttgacctacaaaaatagcaatttcatatggtttgtctaacaaataacattatgagcttttctaattttgacacatcctcacattcctggaatcaaacctacttggtcgtctttgtttgcttgtttgttttttgagacggagtctctctctgtcacccaggctggagtgcagtggctgcaatcttggctcactgcaagctccaccttccaggttcacgccattctcctgccctagcttcccaagtagctgggactacaggcacccgccatcacgtcccgctaattttttttttttttttgtatttttactagagacagggtttcactgtattaaccaggatggtctcatctttgttttaatacatagccaaattcaatcagatttatactcaaaatttttagatctgtgatcaaaagtgagactgccctaatagtttctgatttctgttctttttaaaatttttattttaaattataaattgataaattatagctgaatatattcatgcagtagaaagtatgttatgatttatgaatacgatgtggaattagtaaatcaaactaacataaccatcacctcaaatacttatctttttctgtggtgagaacatttgaaatttactcttttagtgattttgaaatgtatgatacattattatttgctatattcactgtaacgtgcaatacatctcaaaggaaaaagaaacccttaattcttctgtctaattgatgctttctatactttgaccattatctccccattccctcaatcccctggtaaccataattttactcgttgataccaaagtttctacttgcctcattaagaaaaaatgagttgggagatggttctttatttttctctcttctgaagagtttattgcagggattaattgcttcttgaagttttgttaagcttacctgtaaaatagttaaggcctggggcttttgagagaggatacgggggaatcataattttttaatggtcattgtttttttttcagattttttttaatattagtactttttatctataaaaatttccatttcatctgagctttcagatttcttggcttacagttgttcctaaacattccttctcttttttgaaaaagggtctcactttgtcgcccaggctggagtgcagtggcgtgatccctaaacattttcttatttccataatctctcctatatctttgattatgtcccttttcaattcctaatattacatatttgtggcttctttattccttgatcagttctgctagtattgtctactttattatttaaaaaaaaaaaaaacagttggtttggttgacaattgctattgctttttagttttgtttctctagtcatttctgcctttatctttaaaagtatctttctcctactttcttctgatttattatgttacattattcaagctacccaaatctttatttatcgttaagttaggtgatatgtcacagacttacagaggtatattaaaatcttccatgatggctgtaactttattaaattgttttacatttccagcggtttttatttaatttattcgtgctatgttatttggcacataaagttttactgtggattgattatccattttattaatataaaataatcctctttttcatttccttatgagatgtgggagaaattctcaaatttatcttttaataaactgatttcatttttctgtggtttaccatcttccgttcattgcctccattccattttttaattgggtgatcatgtttttcatctctattcaatctctcctcatctcagattgctctgttttcattattgcctatttttgtgtcataaatataatattctctcaaattctcttaagaatacaaattaggagcttttaaagtatgtctctgttcttcgttgcctacagaggggcaattagctctgattccgaagacatgtcttcttcttctgatctactgaatatttacacatatccagttaattttcttgttggcacaccacaacagagggaaaatggaaattgggaatggaaacactcagcagtctctaagggagagcagaggagctaaactcaaagaggccgtagcaggagcatttcctaccctggtgctaaagagtgtgtgtgtgtgtgcatgtacgtgtgtgtgtgtgcgcgtgcatgtgtttgtgcgtgcgtgtgtatgtgtgtgtgcgtgtgtgcattgtgtgcgtgtgcatgtgtgtgcatgtgtttgtgtatgcgtgtgtgtgtgcacgtatgtgtgtgcactacctgggctcctgcatcctctgttagtcctccctgaactctgacctaggttttatgccccatgtccctcctcctttcttaccctgaccacctcagaaagactctctctgcttatctactgagctgcccacctgaccctgaagccagaaccctgacggtgccgttgagtgtgcacacctgctgactatgtcttaggtgctattctgaatctagacccccttagtgaggaagcatgggcactggccatactccatatgacctccagcaacctgggagccatttctgctggctctatcaggtcacttgcacagaaccactgcttatactcccttcaaaacctgaaaattgtaaactatgcctcaaagctggctttttgtgctaatggccttcatccaagaaagcctctgcattgcccagcttgcgttactccatctgtacctctacagagaggaggtccctctggtgctgctgtactgattgcaccctctgagactcaaatggatggagggaagtgaaggtcaagggtgatgcctaaagacatggttattggaagggcataaaacccttgtcttgtattctcttgttgggagacacacactgtttttatgtggggttggaaagcagagcttaagaagccaatgagattgttctatcccatttcaggcacatccagtcccagccagtgatctcatgagtgaatcttcttgggttcaaaaaggattaggtaagagtgagaaatgcatttcaaacacgcacgcgtgcacacgcgcgcgcgcgcacacacacacacacacacacacacacacacacacacacacacacacaccatacaccccagaggacatatgccccagggggttggccaagagtatccatcatctgtacataaaaaggacagcacatttatcacatctggagataatctgaaagcatggaaatttaatggtttatctttggattttccagagtagtgggctctggttcaactttttccaatgtaaggacttctctggctacaaggaataaaactatattagaaaaagctaaaaaaattccttggcctagaatgaaaatgaacatgctttgtatgaggctttccttatcattcattttattaaggcagctctttaataaattctccacgctcaactctgtgattacacagacatacaccacacattattggaggtactcaatcacatattctttgtatttatgcaaagaaacataagacatatatgctcagtgtcttaacaaatccctctctatgaccttctctgtaatccaagtcctatcatttccttcccttacatatgtctcaaactcactttctttaaccccactgccacaccaggccatcatcgtagtacactgaagctactgcaatagcctgttattcaaccaaaacatacacaatgcacaagtgcacatacacacaatatgctgacacaggtatgcacagacacagatccccaaaaccaaataaatacatggacaccgattcacacacaggtggaaacatatttaaaaaagcatctatatccataaatacatagctacacaaatgaacacacacatgcatatatatacatgttctatgagctcttcatcatccatgttgacggtcagggctcaaaatggaaaactggatccattggctgctccaaccgaacttattattattattattattattattttgagacagggtctgactctgtcacccagtctggagtgcagtggcatgatcatggctcactgtaacctcaacctccctggctcaagtgaccctcccacctcagcctacccagtagctgggactacaggcatgcaccaccacacccagctaatttttgtattttttgtagagatggggctttgccatgttccctaagctaaattattgtcttttattatgcagtcaacccatactcaattacacatgcatttgatagcaggcagcttctaaacaaactctaaaaccatattcttagatacccatatacccctctcttttggtcctctctttctcccagatgagtgaggacagtattttgggactcaggaaggaaggagaaagtttggatcattcacacagagacaaaggagtgagtattgactagactattgcatactataacacacatactctgaaatcgatcaattttaccttgaggacatctccttcggagagttcgaatgccctggctttcagctgaattcccttccctggctgggtctggatggagtagatgcattcatgattgttattgtagttcacaggaaagttgggggacagcaaagtaccctgagtgcctgtgactgaattcccacactcagctggaaagagaatcacaataaccatagattaacccccatcagctgcatccagaaagcaactcacagctctgaagaacctgacaaagatgacaagtcgtttgcctgtctacctgccaaggtgcctgcgtgtctgtccagttgttggactgtctacagaaatgcctctcaaacttaaaaaaaaaatacttccctacctatggtgctgcctgctttgtttctgtctcttgtgctgtttgtctgtctctctcctacagaaacagacgctaacccaccaggcatcctttacaatttctcagtgctataaagcagccgtgccacatacctattcatatagtagcgtagcaacagaaatgaccgaggaggaggtcaggggaagaggggggcagttaagtgaggagagatgaagcctttcagtatcacagaatagaaactaagagggggcaagatcacatcataatcgctaacccttatgtgcaaaacagcacgattgacactttacaaggaccatttcagtcattagtcgcaacagccagccccataatgtaggcacaatgatcatttctggtttaaagataaggaaccaggtactcaaccactgagaccaagcctctctgtggattcacgaggaggagggggctgagaactcaacctcctgggtcctggggaaagtttttagcatagtctcattgcagcctgtttcattcaacagctaatgaaatcacaccctcctctggaaactgcttctcctcctccagaattagtcattctttccccattgttctcatacctttatttatagtagtcatcccattttacttcacttatttgttaacatttctatgtcctctactgcactgtggatcctttggggcttggtcgtgttactgtctccttaacacccacacagtgcgtaggcagggcaggcttagggcatgcacagaggaatgggatctttaataattggggggcccctccctgttccttcctgtatctgagcacctcccatattgcaccttgattgcttgctgcctgtcctgtgtcccccacctaaactgtcagtaacttgagggctagggtcatgctggatgaatctatgaatttccaaggcttagcctggattgtctgtaaaataaatatttactgaatgaatgaatgaatgaatgaatgaatggatatggagtacactgacctcagaagatgtacagtcctaaaaataataattaggttccggaaggatgtaaatacaagtccagatggcaggcctgttattcgtgtggacatatggggaatttggagcatgccttgaatctttcaggcggctggtagcaaatctgctttctctaaaccatccctcagtatccttcagtccaggcacagtctgtggctagaaaagccctggggttgaccaaagggccattgcttgggccttatagttaaccctaattaccctaagccaggagcgtactaggctgaggcagcatagatggagaacatggaaaccttcagaacatggaaacataagctgctcatgggcttagttatacatcttgtgttttatcttgtcctaaggctcctcattagtcctttgaagatgggggccacatgtcccaccaccaagtccctacttttctgaatggaccctcctccctgtgtcctgctcaattcaggaccagcttcagtttcctaagactttatatatggcctcatttatttctcttggaggagaaatctaactttacagtacttttaaacttagtctgtttgcaaaacttccaaatatcatgatgaatgtgctgagatggctcataaaactcaagggacagtggtgggcaggctccctgggggcagtggctgctgataatttacatagacgtttccagcatgtgtacatttctttgatgatctcagatgagggtgagggtgaggatttgtcggggggagggggagttgcttagggccatgcatatgtaaacacttattactcagtcatatcacatgggcagccttctgaagcatctctccattttctctgagattactacctttcccctccatctaggcagaggcctgtggtgcagtgggatgatcatggactttggagttagatacattgtgtcaactcactgaaatttaatctcttcatctgccttcatctggacaataatagcattctcataagactgtagaatcaacgcatgagattttatatataagataggtaaacataggggaatggttagcacatagtagcctctccaccaatgtcccaggtgaatctacatggattacctgcttccatttggaaccctaactgcctggattctgggactggcagaaagcctgagaagcatatgggaagcgtgcattagctgcccgaggctcacagcaccctcatggttcctgatgcctcttgccctctgcctaattctcgacagctggcttcccttaaacatgggcttgggtgtgtttttggacctccttcctggccctgcttcctgcataagagctatgtgccccacctctgccccagcacgagcctctcctccttcccacacgcctgatacctttacgaggaggggctgatagctttagatgtggccagtccttggccaatccccaggtcctgactccctgtcaggcctttgtcctgggcaccagggaggggacaggagggatagagggacggggcacttgcttccgggagagtctccaaagtaacaggggaggtgaacagatgaacttagaagccaaacacaggcacaaatggaaacaaataaatgttccagagaaacaaacagtcacaaccacaggtaagtgctgtggctgattctggcatctgtgacttctgtcgcccccatcagaaggggtctcgttaagggcagaggttgtaccttatccatcagcctggggcttctgaggcagagggttaggtcttctccatcacaccaggattcccaaggacagggccatgtctcttgctgcagactggggtcccctggggtcagggctgtctcttctacatcaaattcaggggcccctgatgtcaggggctatgtcacctccctccccgccacccacgtcacaccatgcattaaagcccagggctgttcatctccttctcggctggaaatgttcctggtagcactatgtggactaaatcatccaatttgcatggcgactgggagcagcccccggtgggcattcctgagatgcctccagcctgagcctcggcagcagggctggtggtaattagaggtgactataactactgtgcattattaataacatgtgaaacagaagacaaatgtaataatgaaaatattgtgaggtgtcatgaacaaacagtaattggaataataagttaaagaatgagtttatgtaatgagatcaatgaggcaagagcttaagggctgtgtgcatctgtggtcctggttaattccattcaaggagaatttcccccagaaccatttagctgaggatgctttcccagagactaaaggagctgctagcagccagacatgaactgaaccttcctggggtgggtggcggggttctatgtgtttctgagtgtgtgtggccagatcagggtgggtggatgcctttggggatggttataggagacggagtaaaccctggggttatttaattgttcagaaatggaattctgtagctctttgttttaatgtttcctttctgagattgtaaaaggttattggcaaaataacaataattggttattgataaatacagataaaaatgttattggcaaaatgctgataattatatgccacctcttggtttatgtaaatgatgtcatctaaggtagagtaaagcctgtgaattggatgctgttatctctgttttataaacaaggaagctgaggttaagggggtttgctggcctgcctgagatctaggcgttggtaagtggcagagcagtgaccccaccttggcctgcatgagtgcacagcctgggcccggctcatcttgccagcctgtctaagctgtcctcggcatagcctgagggctccatggacttgtctcgggcacagctgacctcactggcatttgagatgctggtccctgtttcagtcagtgcagtgctgctttgatctgttttgtatatttttatggggttttatatactatttcactttacgtgaggtccatggctaacagtgagcatggaaaatactccatgaatgcagctagtgttttatccagccctacattataaggattgagcaaacaggcacccaggagcctcatacattagggacagacagcaatcactccgccctggggaaaatacttgcttcccctactacctgggcacagcgctctgaacagacttctttaaagctcttgcaaggaggctggcagggcccacttccaacttccaacagctgcctctaacctccacatctcctgttctccctgccgcttgctccagcttggcctctgagctgttcctcaaatgctgagcatgctcatggtttgggtcttggtcctctgttccctcttctcccagatatctatctctggccaaacgtcaactcatcagagaggccttttctgaccatgataaaagagcaaccctagctccagcactttctaagctgacttaatttttctctgtatgcctcaacactgcctgacacatcacatatctaaatattcacagcttgtgtccccaccaccagaatgtggaccacgagtgaagaatttctctgttttgttcacctttgtaccttcagaacctagcagatgcctgagatgtagtgggtcatctataaatgaccccgcccctgttccttttgtcctcccctgctgaatggatgaagccttcctaaggcgtctctaagagtgagcaccgccattggattagtaaaagcacccatctactcctccagatggggactccccctgggcaaaggtcatatacccctcctacaggcccacctagtgcccatccagattcctcggtaagaggcatccttaagccatgggtctgtgtgctgagggtggggaggtaagagtactgaaatcgacttcatgtgagtgcccactgtggacctaatttgtaaaggtcactgtagtttatacagaactgcctgatgaagcagggattgccatccctattttgcagataaggaggatggagcagaaggaggttaggttacctgccccgggtcccactgcaggtaagtgtggtaagtgtgggctaagtcagcctcttggcctgtgtgccgtccaccacctcacatcaattgactataatctgtcccaccccattagtgaagcaaaatgaaagcacgtgaccacctaccaacacaccttggcagaggcgagctccacaggcgccgtctgccccccaggcacgtgatgcgggcggtgccctccagacggtacccggggaagcaggagaaggtcaaggtgtcgcccacgccaaactgcaagcccttccggatgctgtaggctgggacctcgggctcctcacagggctccaagtcgtactctggaaaggtagcaggagatccgggctcagagacattgcggggagacacaaagcaaaaagatgggaacgcacaggcaaaacaccagggggaaagggccagggacaacgaaagacagagaagagggcatgcgcacactggcccacaaaaggtgacactggcccaaaaagagaagaagtgagagcccgaggggagcagaggcagagagaaacatggggaagcacggggaggcagaggcagagagaagcacggggaggccaggacgggcggtctgcacccactcctgtgagcagtgaaagggcacagcctttcctagacaggcttcccaggaggatttctgaggatcctcaggactcagctcttctctgtgctatccttttatctccattttaaacctgtgccttggggctcacaggctctcctgcttccttgtctctgggcaacaaactagatacattcaaccagcaggttctagaaggtcagaatacatgacttagcctcaggcaactcccactggtgaagacactccaaatgcctgacgagaagccatgtctcagctacgttggcacttgaggcagacggcaagcatgaccaggggcatttatgggccaaagccctgcctggggcctctagtgacagcatagaagtgactagtccctcgtctgcaagggcttctcccttcaggatgcagtcctccagggatgtgtgatgagaaagagggtctctctcataagggttgagtctcactggctggatatgtcccattggccaagtgaatccagggatgtgacaggtgacttctgcattggaggcctggcaggggactaagctgggccacaccccagttcctagaagctggatacctcttgtccatcccaggaggaatccatctgatactcctggccgtggctgagaaaggtggagggaggtactctggggtgctacgggacaagaatggtgaagggctcggtatgagaggagccaagggtcctcttttctccctgaatgccaaataaaagcactttcttttccaaatccctaaacagagagataaatatctattactacaaaattagcattgatgaaaaagatcccaaatgagactaaaccactccaatatgttaatttcaaaccttttttttttttcatattgctggggttggcaatgtggaagtggaatcagaagaaaaatctcgaataactaaggtaggaagggacttttgtgaagtcctctagttcatccagctaggtgggccatgttcagagcaaatcctaaacaccttcatagaataagaatcctcagtgattatgctaactccttccaagaccattataggtaagttcttacttgggtctaacccaagcatcttttgctgaagcactaaggtcaacttcccagggactggagagtggattaatatctatctgctaggaaaaccagagactggtagcagaaggagagagcaaatagcaccatggtctcttcccctcagggaccctcatactctttacctgagaaggtgatgttgaatccttcatatgacatggagaaatcagagatgaagcggacctgggcagtgaagttgccatagagcccagcgctgatgggagctggcagccgagatccagttagctgcctcaggggctgggtgaagctgccgttctcagtgatgaggaggtagtcatggccactttccaggtggaaggtgtggaaagtgaagaacacacctgccaagagaccagagggtcaggttgttgatggcgagatggctggagaacctcagctgcaagacaggatctacacaaacatttccagtttgcaaatgtctatctgtgtgtatgactacaagcatgcattgacaaatcatacaggtgaatctgaatgaaggaacctgaacacacaagtgcccagagattcagtcagggagaagaattttacagttcttcttttacagttctaaaattacagggagaattttacagttctcaaaatttaaaagagagatttatggcttgacctatgagaatgctttagagacattcattaattcatccaacaagcatttgtgtatttgttgagtctttactatgggctaggatccagggttaggtgcaagaggatataccagacattaaacgaatagctgcaatacagagtgctgagtgctggaatgaatgtagacagcatgccatgggggccggaacagaaagcagttgacagcaggaagaggcaggtggaggatggcttcaccaaggagtaaacaattgacatggatcttaaaaggatgcacaggaattaaccaggtaagggaaggaagagtgtcccaggcaggagacccatatgtgtaaagggactgtcaattccaggtttgttgagcagcagctgggtgtggctactcctggaattgaagctggataggtagacgggggccagacccaatatttttctggaggcaatgagaagccatcctatccagagtggaccagatctcagttttagcaagatgttggtggctgtaaggaggatgaagtggagggagagcagggagggagatcagttatattggtggctgctctgcactgggagaggatggggcttggcagaaggagcaagagcaggagatggccatgagccttcaggggtcagggtagggtagccaagacagcaggcacttaatgcaaaggagaaataacatgacatccagtggcacgtccacctgaaggatggtgatgtcttctgttacctagggaagggcacgcaggaggaaggtgtgggttgtagaagagtaatggacttagccttttctgcatgcaagcagtgagagctagtgggccactggaaggacagatttggaagttcaggattaaagggggactacagaggtagatttgagtcaccagcaaatagttgatatctgaagccacaagcaaggagaagagggctaggagagaagagggcagagtgagaatcagagaaggggtgattggaagcatgggcagaagtgacagggagtaggagaccaggtgaagttggagcgatgggggagatggtcaaagagcaatcagagagctggaaagagggaggagggagctccagtaagggggaaggttaagagcataaaataaaatcaaagtaatgatattcattaacatttcaagcactaaatatttactgtcctaactgcttttacttgcactatagtcagcccctgtcccttggaagggagacagaaaaactcatttaattctgccaggaaccctgtggcgtgggtatgttattatcatctccagtttacatccaaggaaacggaggcacaaagagatgaagtcatctgtccaaggtcgcccagctagtatgtggtagagctaggatctgaactaaggcaatccgattgcagaggctgtgctctcagctactccagggtgcggcctctcaggctacagaaagagagcaggtagttaagaacagccaggtagggtaagagatcaggtagtgagggaagttatagagcagcatggtcttaacacccaaagcaattctagaacttgtccagatggcagttgtgtttggtgggcatgtgtgtaagtgcgtggccatgcacatgggccatgccccatgtcggagcttgaatccagatttgatgtgacagatgcacacacaaatacttaacttgaatgaaccatgcagaatcacaccaagtgagtatcctattgggactatgtgttgtggatggtgccaggacaggaactcatgttagactaggacccacctgctactccaagtgtgatcccactttctactcaaagtatggtccatgaaccagcagtgtggtcagcactgggggacttactagaattgcagaatctttggcctccactgaagacctactgaatcagaatctgcatgctcttcagatcccaaatgatttatacacacttacaatttgagaagtacttctctagataattactgctacattttttataaatgatggttggagataagcctctaatgctaaagcattttaaaggtttttatatccttgcatctctgttgatagaggctggtgatcctggaggatttgggcttctatagatagaggtggaggagacagaacccaacagaagcgatgggaccaaagatgcagcttgtaaataccctgttcccaggcaactgagaagcatcaaggcctaagcacctaccaagtgccaggccttgtgctaagcactgagaaagatctcccagtttagtggagaagacagacacatcactactagtgagaattcagagtggggcatggaggaagaatgggaactatgcctcactggttgggaaggcttcacgggggtcaaaatccttgatgtgaaaaggcttgtgggtgcatgtgcccacgtgcatgctctactcctgacatacaaacatgtctgcaaatgagaaaactgttctcagtctatacagcttaggaaatatacgtcctttccctcctacctaggacatggagttgggtggagagcgggtgagacccagtcacaggtggaaacaagttgattaagcatcgcgctttgcactctattcttctagcatgcaaatagagcccttccaaaggggtaaacatttggctgggattctaaggatgagcaaacatctgagctgaaacctctgggtttcccagctgcgctgactgcttggggctttttgggccattgtgtgaaaatgaagacattgttgcagaaatagagaggccccatgttggagtttgaatccagatttgatgtgacagatgcacacacaaatacttcacttgactgaaccaagcaaaatcgtaccaatgacatcaataccacataggagcagaaagagcagggcagtggaaaaggcatggacttgggggtaagaaacacctggatcaaaagcccatttacctgctcaaaggtcttggctaaggttgcttaacacctcaggttccaggttcttcaactgtaatatgtaggcaataatatctctcttacaggtgacatttacccccgaagtgagtcataactgggaaagtatatgcaaagcacacagcatagtggctggcacacagtaggggtgcaacagaaggcattccctttgctcaactcatctaactcccggaaagcctcacgggttaaaaggtgtcagctctggggtctcagcaagggcacattctcaggactcctgaattggctgctcccttggactgggcaggtggcaagttgaactatttcaaatttcacagagttttgagtttcctgagccatactgctgcctcttagggagcaatcacagacagcagcttaataggtctgttaacccgagatactcttagaaacagagaacgaagaatgccctctggagaagggcctgggctcagttcaatttgattcatatcaccaaatgcttcttgagttccttatgtgccgggcatagagccagaagccaagaaaactacaggaaacaagacagacctatctctcacagagctcctagtctgtcagggagactgatgatgaaaatgcaagttctctacagtggagtaaagtctgaaatcatggaggtatagaatgcatgctatgggagcccaggggagaagagcccaacctagatgcagagctggggagagggggtcagggaaggctcattagaggaaggggattcagaaggatgaagggctggccaggcaagggcaacggcagagattcccattccccttgcttggggagacgaagtgttccagagagaagaacattgtacaaatgtgtaaagctctagaggagaagggaagcctggcaagttccagaaactgaaggaagttttgtgtagctagaacttagtttagagggctcagaatgaggctgagacaggtaaggactatgaggctgtgccagctattttattttattttatttcttattttttgagatgaagttttgctcttgttgcccaggctggagtgcaatggcacgatctcggctcaccgcaacctctgcctcctgggtttaagcaattctcctgcctcagcctcctgagtagctgggattacaggcatgtgccacccccgccaaataattttttttgtatttttagtagacacggggtttctccatgttggtcaggctggcctcgaactcccaacctcaggtgatctgcctgccttgacacccaaagtgctgggattacaggcatgagccaccgtgcctggcctagcgattttataatttggggatctatgctaagaattaggtgatgcctttaagtggttctaaggaagaagtgatctggtcattcatccatgatttcttgttgattctctgctgagcacctttcaaccgggctatgtcctgttcatctttgaagaccagctgaagtctcaactccaggacaccttcctaagccctgggctgggcttgggatgttttcacatctctgtctgctctatcacatattggtcatgctatatactgagatcttggtttaggctgtctactaccactaaagcataaacttcctgaaggcaggcactggcagagtggcttgttcagctgttttcctagcaatttgggtagtgcaagtatcaaataaacatttgtaaaatagttggtgagcttgattgacttccaggaaaaaacacacacatagaaactcacagaaaaacatacacctcctgtaatcacagatgcccagacacagagaaaaccacaatgacaggggttgtttctctagggatcgtgaggggctgcttttctttccaatggtctcctctgaccaggcttggtggaaacagctctgcaggatgaacaaggacactgttccagccctcccctccttaggaacaatgttgtgggaagcggacaatcctgggcctcaccctgaccacctggctagtcttgccttgatgcagtaagctccaggccaccctagccctgggtagggcaggcctagtaaaggccaagtgacacacttaagtacatgtggtgggactataaatgacttttctttcaaatcttctttgttatacaaatagtatattttagatgtaatgtgtttactgctcaaaattagaaaaaagccaaaagatgaaaataagagacaacatcttggggtatattttttccaggctgttttctatgcaaacaaggatgtcttttaaactaaatatattcttttggcaaacttattttttttacttaacaaagtattgcaaccacccctgtaggtctttaaatattctttcatgttattccttttaggagctgcctagtattttattctatggccataccctatgtttatttaacatttccttattgatggacattttaatagttcttaatttttcagtataatacataatatcttaggggaaatctttgaagctaaatcttgatgtagagttttacttattttcttcagataaattccagtaagtggaattgctagatgcaaaggcaggtacagttgtccctctgtatctgcaggggatttgttccaggaccacccttggataccaaaatctgcagattcctaagtcccttacaatatattttcgagacttttgattcacatcaccaagtcaccctctggaatgcctgaaccatttcgcacaatgtcagcagtcaatagcatgcaagtgtccacattatcccccagactgttacaattttctttgatgacttaaaaagggaaatggtatttctcttttaaaattacacttgtttcattattaatgaggtccatgattttccatttgtatttcctctgttacaaagtgttactttatagctttgctcattttgcgggctggtttggctaggcatatgtctcctaaaaattttaaagaactctttgtgtgtctggttgctaatccttagtcgatcacatgttgcgatttttttttttctatttagtatttgactttaaatttttatggaactttttttttttaacctaaatcctttcaaagttttttttaattgaatctagcagtctttgcctttatggattctacctttgttgttactctttaaagtacgtgcccacctgaggttagagattcatgttcctctagtgctggagtttatgtgattaaatgcttgagaatgcttgaggtatagacggtttttttttcttttgttccaatggttcaacccactgttttaacaccatttattacataatccatcctttcttcaatggatctgaaatgacactttacttatatactaaagtctgtctctttctcacacgtacacaggcatgtgtgtgcacacacggagggatctatttctggacaattattctccacgtcttatttgtatgtccactcttgtactcataccacattgttaacattaatttagcccataacaacattttaatatccggaaggattaatcttcctttaaaattagttttttggctcttctgcatgttaattcttctagatcagaggttcttaattaaaagcatgcatcaaaattactggcaaagtgttctgaaaacatagatgcctggtttccaccgccaacgtagaaaatcaaaacctctagccttgggcctaagcattagtgtatttgccaaactgcaagaaccatgactctggatgaacttggcaataagcttctgaggctagaagccaaatctgcctggttactgctgatgcccagccccagtgtcagccacatgggtggcaccgaatacatatttgttgagaaaagagtattaatatattaattaacatttatttataaccagcacttttactttgaacttggactcccaaaggtcactcacgttaggggagctgaggcagcagtgcaggctggtgacccatatgaaagatggcatcaggggaggagctgagttatgcaagaaggggatcgctgtgttcagtatctgaagggtgaatgtgaagaagagggagcaggtgtatctgatgctcctccaggatgcaatacaagaaaaacattttcagagacacctaatagactattagaagaaagcatctgtgcaaaaatgatagtaggtgcccatctgttgaacgggttggtggcctccccacatcaggcatgtttaggcagagggtgagctgagctggcgtgttgccatcttgcagggagtgatttagagaaggttcctgtactgagtgagattggacagctggtaacctctaagagctcttccagcagggagattttagaatctcaacaatacttattgaacaagttctaccattcaaagggatgagaagactctggaagttttcttgttggtgagaaaagttcagacgaagcccagaggtcactatctagggagatccccattgaggtcaacttgacctgaggaacttgggtccctgacctcgtcacatcccaatgcctgctatgggctgaaacactcacccttgccatgagatgtttcgataatccaggtgcagttcaagttgttggggtagaagtcagggaaccctggcgacaagatggtcccactggagccttgaatgaagccaccacagagagctacagaaggagtgaagagggcagtgaaagaccagagggcctcaggggagcacccccgtcatcctcctgggaccccatcccccatctctcgaaagcccaaccttcgctgatggggtgagggagtcagtggtcttttgagcacctgtgtttctgtggcaggagaggagtctgctactttagcgccccctcatggtgtccctcaccttcacaactgggcagggcccggctccactggaagttgggctcacactccagaggctccccgtcacttaatgtgtagcccgagtcacagctgaaggtcaccagcgcgcccacgtagaagtcattcccatgacgctgtccatttactgggattcctggatccagacagtggtctgactgcagtgttatagctgaaagagagaggccacagctgggacagacagcttactgtcactacagagggaccccagttgactccaaagagtaagaagagagccctggtttattaaaggcagaagttgccaattactgactcatgaaatgtggccgtcagaatttgctgagagtggcttaggtgctatgctaaggcttaggagtaagaaaatgaccttgtcctcatggtgctcgcagctccagctttctatgttggtctacagagaactgaagtgacaatgatcctttaaatcgaggggatgaatgtgggaggtgatgaggaaggacaagtgtgggtgtgagatgccatcttgggttaacttcatggtcagtcaaatgttctgatcccagagtgcccagcgtggcggcacccaatcacctgccaggaggtctgcacgcaagggcctagcgtgaaggttgtgaacaactctaagctcccatgacctgagggatgctgagagcaacagagtgccttccccagggccttctgaagggcacagcctagccaagaacaccatggggatggggccaagcaggggcctgtggtggagcacagtcctgaggcctttgacccacctgggctgaccttgtcatcccttttcctgagcccactgagactcactctcatagcggagctggaagccgatgtccgagtgactcttgtcggtagagaagaggaggtagaggtagttgctggtgctgatgaggaactggggaacctgggtcccgtggtaaaccccgatcaagggcgctgagtaagtccgcccatcgcgtacttccagggtgtcatagttgacctcggttttgaatctgccaaatgacagaaatgaagccttcttgagaaatccaagcttattaatttgcaaatgacataaagccctgcctgacccagggcttccgaataaccagattttggcaggctgggatcttttaatataatttgcacacattcactagcgatgcagaaggaccttctccactctatttaacatccctcctcctccttccatggttggaaactgctctcatcctctctgtggcctgatctgtgagccagcttaagacctagaggcacaatgactagcctcatggaggtcagaacattctaggctaggggtcagcacactaaagcctcagggccagatctggtctatagcctggagagctaaggatgctttttacatttgtaaagagatcttaaaaaaaaaaaaaggcaaagcagagcatgcatcagagatatgcaagtaggcaagtggcccacaaagcctaaaatatttaccatctggctcttcacacaaaagtttgcagactgctattccaggccaggaacactttgtccggaagaagtttgttttcacatttaggtggctacgttctccacccaaggggcatagccagggtgggagctagaagtggggcacatgagcaggatttggggcagaggtggggggctgccttcccacgttggacatttccaggagaatgctcgtcagataccagagtcatgctttaacatctgatggtgtctatctgcccactccccctccttgggggctggggaggggggagctctaacatcccaaatggtacccaagccttctcttcacccctcctgccatagtcccctaaacagcacaaaccaagcccaagggcagagccagtgaggtctgccccacccagggcaatttggtccagtgttctccaaccttgctgacatttcagcgttggtactggtcccctatccaccctgcattccctcccacgtggctctgtaaaaatctcccccttgccctctcccccaaggctgtggtcacaagcacctgtcgaaggtgattttgatggggtagcctggctgggcctcaatcacccaggcacagctcaaggcatccttgtagaagccaggccagcccggagagaggatggtgccgctgggcgaagtcaggtgaccaccacagggagctggggggacagaaggaagagaggcagctttcttcagggacaaatgagtaaacaaacagaaaatctctctataaaatgtgtcaggcaataagtatagtttttgtttttatggaaaattacataaactataaactgtgagttttgtctactgggacctttatgggtaggtccagttatatcatgtggagtgttattaaaggccagatgggagaaatgaaaagaatcctttaagcaaagtccctttgtcattctagaagggctgaagtacaactaatatttgggccacatggtgtttttccttcgttcctcactcaattgtcaggcctgaggcaggggcatagacccagccaacctcctcacatctggccctggagaaggtcagaaccccaggaccctacaactcagacgttcagctcagggtgccggtactccctgcttcactgtaaactccaggagggcatgggatgtgttaattgtgttacacaactgggtatccccagtattgagcatggtgcttggcacacagttgtttctcaatgattgctggttggatgaatcaatgagttaatgacaggatgaatgaatacagtccaaggcagggaactccacaggacactgggaggcctaggcacagctgctggctgtctctggtcttgcaaagtctgttatttatgcctctgtccacatgtcccatcctgggcttccccattctcagctgcctctttcccaccaccactgtctcttcctgcaaccagaccctcagcccctaaggtagtcattagagctattcctctttcaagggcacatgattggatttcactgcccaccccttttgaagttatgcaaggtcacgtgactgctgtgaccaataaaatgagagcagaagtgctgtacatcatgtctctgtggaaactttataagcctgtgtgtgatctgcacacagtttccttttccggcctcggtaattgtggaagcaagtgtcaagagggaagtctcatcaatctgggcccctaagtgactctaaggagcagacatccctgatgacccatgttaaatatgtagcttcagtggtctgtgtgagatataagctcctgatttttaagccgctgggatttggaggttgtaagttaacaccgtgtagcctagcccacccagactagcacacctccccaaggctgatgatgaggatgatgatgacatccactattactgcttctgtcactgccatcaccactgccattgactgggggttgactccacctcagtcaggcactgagcttacatacgtaatcatgttcactctttgcaaaacaaaatcccctgtgaggttggtgctattattacctcctaggaaagctgaggcttacggaggttgagtaactagccttgggttagcaagttgcagagcttggattcagacctaggcaagacagcgtaaatccagagattttaagctaagccgcctcccatgtcaaaggaacctctgctcctttgtactcccttactatggagctatcagatgccaaaaattccctgaacaagactggggaggaataaagagctacatagcacttctctctctgcaaagttttgtagatttctcgaggtaatcagtttcataaaagatagtctaatatacccaatcctcttttttttttaatgctataaccttcaagaattatctaaaatagttgtcaagtattcttaatagaaacttatattaggaagtttaattaacaaagaagattataataagggtagtagtcgtcaactcttactgatgacttactatgctaattgctacacatgtgttatctcatttaaatgcatgcatttatgaagttattatccctattttatagagaagaaaactaaggccaagtaggttaagagactagatcaaggatacagagctaatgaaattagagctgagattgaatctcaagacttctgtctctaaatcccccgtgacacataatagtgctacaaccacagccaacagtaataagctcatgtgtatcgataacttactatgtgtcagggcttaatgtggattatccttgtgacaatggcaacactaaatggcacgtactattatcatcctcgttttataggcggggattattaccccattttcagtaaattgaggcttagagaaactaaataattacatagagctatatcaaacattgggagagtaaattgtgtatgtgtattgtcacttcctgggtaaccccagttttcaaaacccatccatccatctcactgcaactactaatgctttcctccatttctcaggtggacacatgagaccttagaggtggggaggggcgtgcctattgctacatcccattgttacaatacaggtttgcatctcagcagtgaggagggactctttcttggctccatctcagcacaggcccagcatctctggttgttggactgtgatttccccatttactgcccggggagctacagatcatgcagtctccattgcctgtctaggccactctccactcagtgcatacatatcaacgaaaccccatctacaatctccagagagggaaattcaatcccttcctttggcggtcaccactttgctttctttctctgctgtgttgcttcattagtttggctagttaatctcttcctgtgcacctgtgattgtccagtgacctatttaatcattctgtccttcactttctctgttgttcatcttcatattgcagagtggtagttgcccggcagggatttggaggggaggattctttttttttttttttttaattttttaaaattttattattattatactttaagttttagagtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttggaggggaggattcttaaatgcaatgtctctttcacatttgaaaagatgattgacctcactcttaaacataaaaatacatattaaaagcacagtgaaatattgtttctcatccatcagataggcaaaatccaaagtttaatgacacatgaggccgtgagaaaccaaggattctaggaccttgctggtgaacgtgcaatatggtacaactgctgtgcagaggaatttggtaatatccaacaaaatgcatatgcatttactctctgacccagcaattctatttctagaactctcccaaagatacactggcaaaaatatgaaatgacatatatgtacaaggttatgcaaggtagcactatttgtgatagcaaatgtatggaaacagcccaaatgttcagtggtagagatctaactgaataaactagggtaatcaacaaaatggactatttatgcagctataaaacaagaatgagggatattctatataatatcatggagtggttcccagactatgttgttaagtgaataaaagcatggtagagattagtaggtatggtatgattctctttatctaagaaaggggcagaggcatacacacatattcactcatattaacaatcactgaaaggataaaccaaaaactaaaagattattcacagaaggacggagggaacagggtagagaagatagggatagaagctaggctttctcagaatataccttttttatatatttagctttggaactatgtaaatattttaaataattaaaatgaaagattaagcaaatcaataaactgataagcaatttctagaaactcagaagcagagtgaaataaatgaatgcaatgctagattagttggtagcataatcccacatgaagaaactagtaaaagagattttaaaacacaataatttgatagcctaccttaataggatacaaaaagaaatgaaaaaaaaaaaaacccttaaactattctctgtaattatattattgttggtagccattggtattactactttgggactcttaggcatgtcctatgaattgggaaattatattaatggtgttgggaactgggattttcagcaagagtgaaaggagatatggatatgatattaaagaagttaagtaaaaaagaaaaagtgtttttacattggaaatgaaataaacccatgacgaattttcttttaaaaactgtttcctagctgtgttcattgaaaaggcttagaaacaggaacgaagtcaataataaaaagtacccctagtgcccaaattttaaatatcagtttccactaaaaggaaccagggtttctaggagaaataactgattctgggtcagagacagaaaatgtacaagatgatgttaggccaacttcaaaaggctcccactagccaatgacacaatttgagcattaattagaacaaactgcagtagatttaaatacataaagtatgtttggattgtaatgatatttaaaaatgtgcaactttggaaggtgttagggaatcaactcattaatacaaaaaccggcaaatacaaataattatttccttgcttttcctttacaaactgtatctcggagtaaccaaatagttgatgaggacaagttttctttaagtgtagcatttcagcttatgaaaaaataaattatagcatgttaccattttgtaattcctagggtatgatcattaatggttcctaatgaccccaaaagagagatacccaaatatcatatgattctgttgaagacattgcctacaagatattctcgctaaaaaaatggaagttcaatctgattaagtttctagatcttactgccaattaaagggaacataaaagagagacaattgtgttaaacaacctcccagggaagcaactggcaaaattccgaatgcaggagactcctcattctgaataattctcatttatctccagataaatgacccgacttctgcaacaacaaaaaaatctcaagggggtggggagtagacacctatagattagaaaagacttgagacatatcagccaattataatgtatgaagctaacaaggatactgacttaaaaatactatcaaagaacgtattagccaatcatggaaatttgattatattaattgtttttaattttttaaaatgatagcaatgtggttatgttttaaagagctagttttatctgttggagacacattactaaaatgtcatagatgaagtgtgatgactgaaatttgctgcgaaataatcccagaaccagcagggtggttgtgggggaatgggtggggatataaatgaaaacaaaataggccatgagtttataattgttgaggttgactgataggtacatgtgggttcattatactattctctctgttttggtatatgtttgaaatttttcatttaaacaaggtgaaggcaaaaacagggaagcacacacatgtctgtgtgcgtgcacatgcacacacacacacacacaaagaaaagaaggaaaaagaaggaaggatcctctcttgaacagggagaagagctcagcaataagacaaaagagggaccctgtgactgtcccagcacctggtactcactagatgttcaatatttgttgaaggaatgaaatactggttgataggcagggatactgggtgttatggatggaattgtgtcctcccaaaatgtagaggttgaaaccctagccaccaatgtgactgcatttggagagagagcctttcaggaggtaaataaggttaaatgaggtcatgaggatagagccctagtccagtaggactggtgtcctcattataagaggaagacaccaggggtgcatgtgcacaggaaaacaggccacgtgagaacacagagaggaagtgggcatctgcaagccaaggagagatgcttcaggagaaaccagccctgccagtaccttgatcttgaacttccagctttcagacctgtgagaaaataaatttatgttgtttaaggcaccaagtctgtggcactgtgttacggcagcccaggctgactgatacactgagcttctgatgaggggttgctgtcccctgtgagggatgagccacttctcctgaccctgatgctaaagttgtgcaaggcaaagaggaatagggaatggtgacagaatagaatacagagaacaaatactcattgagcactgagctctacaacatgccaggctctgaccttcatgtatgcttttgcttcccctgtgtgttagtcttcacagccacctataaggcgggcacagacattaacctcatttcatagctgagggaacatacttgaggtacaaagagcttaggcgactggccaggaacacacactaggaagtcgcagggtcaggatttaaacctgggcagtccagctccagagcctgcatttttaaccactctgggtggacgtgggaatgcccacctcaaccactgcttctgtaacgggatgtaggctgctgctaaggggttttgttgactagctgtccagtgtgagtgaccagaagtagtggaagtcctttcctctgaccagagtgcctctggagttactcagccctgcggctggaagtgttgcctcctactctctagctctgcctccccactacccacctgtgccccttaccacctgtcttccactgttttgtggtagaatataagcagaatgaacttgggactcagacctcacttggaggttaaaagtgatgattctggaatcagaatatctggatttgaaccttgactctctcattcacttagctatggtcttaagcaagttacataaccattttgagcttcagtttcttcatctgtgaagtgaggataacaatacctcctcatgaagagtcaatggggcagtggatgttgatatggttgggctctgtgtccccacccaaatctcacctcgagttataatccccataatccctgcgtgtcaagggcaggaccaggtggaggtaatcggatcatgggggcagtttcccccatgctgctgtcatgatagtgagtcgcaggagatttgatggtttgcatctggcatttcccttgcttgcactcactctgtcctgacgccctgtgaagaaggtgcctgcttctcttttgcctttcaccatgagtgtaagtttcctgaggcctccccagcaatgtgaaactgtgagtcaattaaacctttcctttataaattacccagtcttgggcatttcttcatagcaatgtgagaatggactaatacagatgtaaagcaattggcctggtatttagcacatagtatgtgctcaatgattaccagctgggtgattttgggaacgtcaactcacctcactgtttttgcggattctcatggataaagcacaattacatctttcttgcaagagtggcaagaagattaaatgagagattgctagaaatgcagtaactacccttatagttcttccttaatgccaaaatgagctaccaccaccacttagatttctttgtggtcatgaggagaactgaccttctttctttattacagtacttgcttttttcctgattttaaaagtaacacatttggtgtagatagagaataaatgtggatgtgtttataccaaactgttaaaccattttcctctggggagtgggactgggaaatgagcatttccactttgagctgtattgcacttgtgcatcatttgaaatttttacaaccaccaagtattcctttatttgtttatttgacagagtctagctctgtcgcccaggctggagagcagtagtacaatcatagctcactgcagcctctaattcccaggctcaagcaaccctccgagtatttctttaaaatttaaaaaatgaaaatacaggggccaggtgtggtggctcaagcctgtaatccccgcattttgggaggccgaggctggaagatcatgaggtcaggagtttgagaccagtctggccaacatagtgaaaccccgtctctactaagaatacaaaaattagccaggcatggttgcatacacctgtagtcccagctactcgggaggctgaggcaggagaatcgcttgaacttgggaggcagaggctgcagtgagctgagatcacaccactgcactccagcctggatgacagagcaagattccatctcaaaaaaaaaaaagaaaaaagaaaaagaaaaaagaaaatacacactcactgtagataatttatctttttttgtgtgtatttcttgtaagcagaatattcttaaagctcagctctttgtcttttaatagggagtttaattacttttattatcataactgatatgtttgtcttctgctgtcattttgtttcatgctgtcaatttccgatgtctccatgtgatgtcctgtcttctttgtcttatgcattaggcaatgtatttccttttaattttctacggggatgtcgaaagtagaaatcctgcttttcgttctatttggagatgcttttaagtctttcatagaggtgttggaaactatattctcttcagtgatataattcaagaaaaatacagtaacagggtagccaagagtctggatttgaattctggctccatcatttacaagctgggaagatcctacgcaggtgacttaacctgtctgtgtcctagcagggacaataacgacatctatttcctaggactggtgcaaggttgaaatgaggtgacactgtaagacacttatcctagtggggtatgattatttttcctttaaagagacaaggaagaggtaagtgtaggggagagaaagtcaggcaggtacgccggtgtagctgccttcactacccggaagtctttcttgggaaatttctgattttacacctaagggactcctgtgtcctgtgaactcaagatcacagacttggtcaatctagcccattcacttccgtattgtctaaggctgctgttgcattaggacagcagagttatagcccacacagtcgaaaatacttcctctctggccctttaagaaaaagtttgccgacccctgctttagatcctccagataatcatccttctttctaaatttaggagaagccatcgtctctcttgtcctattatagcctctcaaaagctaagtggctcttagcatatattaaaagattttctaaaagaccattagcttctgcatttaattgtccacaaggtggggacacttaatcaaaaacaaaactagaaaaaaaacggaaaagacaaagatgctgattgcaaagcagagctctaccaaggctcagacaaaaggagggagaggagccaagaagggacaggttcccaggggcttctttagccagctctgtctaaggttttaaggctgggattcagccaccctaagtggcatcaggctctcacactctgcctggcatgcaacttcccagatccctgaaaaccaggctggcatcaaatgcccatcgctctgagaaaaccgagcgggctctccctggggtcagggtctccaatagactgtcccttacttctagtgcctactgccccaaccctacagcatttccccctccagggacagaatgaaaaagacctttttaactttaaaatgaagaccttgcttatgaaatagtgagccgcgggaggctgaggtgggtggatcacgaggtcaggagatcaagaccatcctggctaacacggtgaaaccctgtctctactgaaaatacaaaaaattagctgggtgtggtggtgggcgcctgtagtcccagctacttgggaggctgaggcaggagaatggcgtgaacctgggaggtggagcttgcagtgagccaagatcacgccactgcactccagcctgggcgacagcaagactccgtctcaaagaaaaaaaaaaaatagtgagccacttgaagatccattaacaaaggtcaaattatctcatgtgttcatacatggccttgaaggtttcaatgcatcgcagagctaaagtctaagagcacttgattcaggagggtggcaggtggagaggaggattgtgcagttactaattcctgagggttcctcagagcagtcaactaatttgggactaagcccctgcaggctcaggggcaatgggaatctggccttctgccctgagaccactcacagtcttgttgggcagacaggaccaaggcctgtggaactggtaaatgtaataatggtaagaaccagtatccaagaaagtggtccagtggtggtggcccatgaaaaataatagaaattaggagaaggaagagatcaggtgagctagagacagcagggaagatctcagagatatgaaccaacacaacgaaaactaaagaaattagaagtggtcaatgagtgcaagggaaaatgagggggctggtctgtaggaaggtgaaagaccaccgattcacaaccctccagactgggttctgcatggatgctttgtacggtgacctgtttcaccagcaaataactccatcagatatgcatacttattcccctgttgccagtgagggacctgaggtctaggtctagttacttaacctaagcccattaattctacagctgggaagcatggagactgagtttcgtgttgtttctctaactccaaagcttctgttctttccaaaagtgctgattgcactgaggaagaatggcagatgaggttgtacagaccacactgcgggaagtttggaagtcagaaaaaaatgtctattcatgtcacggttggggcaagttcctggaaggatggaaacgcaccacttgatcccccaaagtggagcaaatattgatctggttggtccaatgaagaaatagttaaaatcaagttaacgctaatggccaacacttattgagtgttacctctcaccaggcactgctccaagaactgtgcatgctcaagacaactcttcaagcgggttcccattatcaacctgcattttacagtggggcaactgaggcacagagaggtcaagttacttccccagggtggcttggatgataagttgcagggtggagacagcaggcagtctggtgagagtcggggctctggaggcctttcattgatatgcgtctcattagggaggctctagcctagttaaaaggccattcattcattcatttattcggtgactcatcaaccagtattgattgagcatctaccaagtatcaaacaacacaccagctgtgggaatatgaggccaaggaagattccctaacctcatggagtttacgtgacagtgaaggcgcagcttatgaggacttactttataccaggactgcctactccatacacatctgataattatcattatccctccttttttttccagctggaaaatacaaaggctcaaggggaaaagtgaattgccaggatcccagcttgggcccctctcactcaaatgcccacctggactgcttgccacctccagtgttctcagtggtcccttgtctcccatcgagccatttgtaagctctgggtaatactctctctcaggcatgctcccttcttcattctcctgtccttcctgttcatggccactatgcccagatttgagtttaggaattgggttaagtcaagaggtctcttaagtctctatcctctttctatcacatgaaatgtgagaagaaggtttctgcctcctaaaaggagagaatcacagccttcgtctccttggatactgtcagtttccccaaggggcccttgggatactcactattcatccattattcacaaatatttattaagcacctattccgtgccaggtaccacggttggtacacaatgcttggtacacaaatttgcctggtgcacaaatgcttggtacaccatgcttggtacacaaatttaacctgactcctgcctcaagaagctttatctgtattttaaatgtctgtagtttggtggaacagatggctggtcttgaaaattgagtcaaaaactgtcttgtgtggcgaggcaggactgaagaactgccatcatcagccgtgtgcctgctgcaagctgtgtttcttctggctggttggccctgagtctcctggagactgaccacaaggatataaagtcagcatttaacagggcacaaaggccgagactgggagacatcccagggaattggggaaaataaacatgtggagaaggaaagagtgacaggcagcttgaaagacccgaaaactcgcagcgctgccaatgctactttgggctgccggagctcccctgggcaggagctggaaacagggatcttaatggctgtgataccgaagagagttctcatttgaaagaagaggtgcttttgatacctgacaatccagagccgtttctctactttaatctctggttataatttaaattcctacgcacagtggccttatgaagcccctgctattccagcatgagggtgagagagtggcccttcgttctgggagaagaggaaggaccaacgcagaaaggaaccaccatggcctgggctgcttgctccccctccccagcctctctggctgacaatggccactgctcccagcctgcaggctcgtaccttcacaccgcagcacagcgctgttccagaccacgctgccctccttcaggacgcaggtgatggtctctgagccctgagtcccaaggaagccttcatcacagaggaaggagatggagctgcccagctggaggctgtccccaaaccgtttgccatttactggaacgccaggatccgggcactcgttgtgtcggaaggctgtgtagatggagttcaaggacatgatcagacattgctggagtagagaagaatccctaaagaaaattagcttccttgggatgggaaaccctagaactccaccacctccccaagaacttgccatgttggcgggagagctaggcattctaggacctcggcattaagcaggtgctcattaaacttgatttcctgccttcccgagcacctaatcccactgcattctaatggacatttatagatcaggcaataagctaagtgtttctgctgttagctcatttacaccacataatgattctatgaagtagctcttgttaccctactttacaaatgaggaaactgaggctcagtgtggttaatgagctgatctgtctcctcaatgtcaaatccattccaagattccctaacttcagacagttatgggatcatttctgcttgaggtgagctggactctaaattctgtgacgctaatagactctaagcatcataaaggaggtgccctagaattaaccctgtctgaagctatttcctttatttccttgcctattgtcagggctgcctctcactctacccaggcaattgataatgcagagtggggagaggacagagtcagaacgctgtagatttaatcatgctttgccttttattcgttacatggtcctggacaacttatgcaattctgatgagccttagtttcctgactgataatatggagatcatccttcacttgcagggtcattctgagatagaaataaaatgaaagttgatgtgaatatgagagtggcaattgttcggtgcggcacgtgacagatggtaagtgctcactgaagatgagttcccttccttcttccctcctctgcatgggaagatactctttcctgctcagtctctaccaagcatgttccctgccttcctccagcaggggcatcacagttctcttactaaatgtctccgaagccaggctctattttcaccccgaagccaggctctattttcacccctgttgttctgaggatggcagctttccagtggagaccaggatccatggctgcatgggtatgggccacttgaaaaaaaaatttcttggcctctgaaattccctagtgatagaaacatttgcacattcagaaacagcagtggccctaggggctgctggatcttgctagaggcaagaggcctgcaaacctgacccttcccattgcagatgaggtaagggagcctctgatgtggagatgactgtgatgatcccatgcagggcttcagttgagtgcccaacacccttccatttgaacgcttaggtcagcccagacttgagtctcccaacctttcttcgttggaaactatgaccacgaagtcaccctgacatttagaaatatggtgtgggaaaaaaaatgatgcttggggcccagaagtccaggcatttttctttcaaatgcatcagtcatacacatgtaggcacagatacatacacccacatatgaacacacacatacacgcgcgcgcgtgcatgcgcacacacacaagcgcaaatgcacatagcaggaatatggagttatttccaacatctgggagcaaaagctctgagtcaaggacccacttctccctgtgtacctttccaaacctcagttttctggcatgtgaaaggggtagatcttgctttatggagtttttgttgtgaggcttccagtgatgactgttgagtgctcagcaccaggttcagcccacaggaggtgcttaatggatggcagctactgtcattgttgttcattatgttccatgtggaagaggaattagccttgttaccgggagttctaggggtggaagtgggaccactgatccttgttacagggacacagatttcaagtcaacataagttgacttgaaatctagagtgcctgctagctatggagagagctgtctggggaggcaagctccctgacactgggcaaattcaagctcagcctcagtgatcatcagttgggatgtaggaggagattaaaatcctatgggagagactacactaattccctgacacttggccatggaggattgtttcactgactgcatccgatcgcctcagaagcctaccaaaaatgtagattctggggccccatccctttagtgattctaattcagcaggtctaggatgcggcccagatttttaaaaattatttctatcaatccatccaactgtctatttgtataaatgcatagaaaactatgtgatatctgtaatagtgtccaccaattgttggcaagaatcatttctggctgggggattttgggtagtggttaacatctctcctttgacctctcccattttttgagtatttacagattggatgtgtatcatttttacaatggtagagaaaccttggaaagaaatacaagtaagagctatcctcaggttagtctgctgccgtcatgatgaagctcagcccctgggccatcagctgcctcctcctcccaagttcccactcagtgtccacacatgctgcaaacccacatgacttcttggccctcaccatcctggataagtgtgctccccaggataccttttatccttgttcttcctactccgccagggcaagagaaagcatttactcattcatggatccttccattccgtaaacatttgctgatccttagcacacaccaggccctgtgcggggccaagggatataaagataaggaaagcatactcgctcctttctagtgtgaagcagcatggtcagtgctagactagggttaggaaagacagaactaggatctccccctgcttcttcctgcccacagcagatgaaacaggaatcccctggaggagacatgccctgagaaggttgattgtgtcctaaacaagagtggtgaggggaatggaatgggctttacctggctggtctcttggaatcgggggacccaaatggcccaccaggtagcatctaatgtcttcagtccaactggactccagagataggtggaaaacggaggcaaggcctttatgccaacggtgggaatgggggttgggagatcagtgtttgtgggcatggagcagagcttgcactggggactcgcccttcacaagcagcctctgggaaaggatctagttaattgctcagatggacccacctccagcctcacttgactgtttgtcatcagccaagtccactggatttatagcttcttacgacctgataaccacttcttgctatctttggtggcttgctatttctagtcaccaagcttctgcccccccccccccaaccccctctgtaaccacgagatacagaaataaaaataatcactgctgagtttaggctgcttctagagaaggggcccaggattgaaactggaggtggcaactttcagatggtggccctcagaggggctatgaggaaattccctaagagttgtccccagtaagtctgggagcccaacagaagtgttgctccaaagctttgattctgatgtgactatgggaatgggaactgggcaaagcaaagtgagcagccccggcacgaactcagaggtcagcagcaggcaggcattcagggatttcggagagcacctcagagagggcatcagaaaccaatgagaatgatagaggctttctttctcttgggccctccctagttctggttgggtcttgtaggatggggaaggttggggcaaaaatgaggttccaggttccttttacattatatatcacaactatgggagataaatgcccttcagagagggacttccagaaaagagcaccctgcctggcagccagtgctttatgccctttcttggtcatgctgggagctccatgactgggcactgcagccctgcaatgccctgggaactgccccatccacacctcctcctccctccatgggagcaccttcgatcatcctcagaggcagacactcagatggagggccagctggtgacagagggaggactcactggtaaaagtgatgttgaagcccctcttccctgtggagtggtcagtctggaactcgagacgggccacgtggccactgcttgtgatggaggagggaagctggtttcctgagaaggtgcccaggacgggcgcctcggcggtggccccatccttgatgaccaggaaatcaaactgaggctccacgtcaatgtcgttgaaggccaggtggatgcggctctcaggcctggccaggatgagccagacacagtggaggtggttgccatagtcctctgggtagttgggagacaggacaaccccagacgggctggtgaagttgaagaagcaggagactgcaagagaagagcagtggaggtcagtaagcatccccaacattctgcctgcaccactgagggctggcagggggaacatcttcttagtctaaaaagcaacagaaagaaagagtggcacaagggttgggctggactggctgggctctgagctccaggtggggagacatgctgggctccatgctggacttagcaatgggtagggcccctttggcaaaaggcagacatggcagaactggtcttctcttggcccctctcccctggtcagcacgcccacctaggatgcggcccagatttttaaaaattatttctatcaatccatccaactgtctatttgtataaatgcatagaaaactatgtgatatctgtaatagtgtccaccaattgttggcaaggatcatttctggctgggggattttgggtagtggttaacatctctcctttgacctctcccattttttgagtatttacagattggatgtgtctggatgtgaaacactgcgtcttcgtgctttgggtcccttgggtggggcaaagccacaactcaagcctaagtgtagagtcacagtccctgacccctctcagctgggtttacagcagtaggaaaggacattgcttaatgacacagcagtgctaattccccaggcggtaaccgggtggagacagcccaggaccatttgtctccttcaaacatttttgatggaaaaatgataggtgtgccatgggattctgacaaccccaagatgccacactatgctaaagaggtgccaggagcaccatctttcagagaccaaagcttctgaagaaactgggggagggaggtgacagcatccattgtgatccctgtccacgtcctgttctctctcccctatttcaccctaaggatccacccttccaaaaacccttattttaagctattttcatgccaactagtagcagaccctggaataagaataggcaaagaaagtgctgtaaatgagaaaacaaataaatactaaaacaaaattataaaagaaaataataaaatgaaaaaaataatcacaacgcttatgacacaggaaaaatatcaatattgaattagaacctttataattatctaagaacatcactaagatgagtaaagagagtgcttagaggattcatatgaaagaaaatagaattaatatgacaacacagtccatttcaatagaaaaaataaagaaaaaatatagaatccaatattgttgaggcttcatggaatctcatacatgcatttattgccaattgcagagcaaaactgatatgatcctttttgaagggagtatgtaagttcgcatccagagccacagaactactcaaagactgactcagtaatctctaggaattaattcaaaagaaaaagagccacctagccaaagatgtttacaatgacataattttattatagaggaaaaatgtgaacaaactatatgtcagcccaataatgtgaggtaaattatagcctttaatgtgatacagtttgactgcaatcattaaagtgataaatatgaccctgtagaaagaatgttaaacataattttaaataaagcagtagatcataaaattatatgcatgcttttgattatagctattaaatatttgtttataaatggataaagactggacataagcccccaaataaaaactatatcagggtcgtaggcgttcaaaatgaaacaacatttaatttttctgattgcaaaaatgctgtaggttcattctaaacatcttttaatatatacaagcataaaaaaggtagttccaaatatggataaacatttaagtccatttataacatttatatagatgtttggtgttaattaaattgatatttaagtgagtaaaatatttgacttactaaaggtaatgatgctaagatgaaaaataataaaatcatgtttgccaaaggggggaaaacattaaaacaaaaaaattggtgactccttgtgatgagtttagtcttgattctccctgactctgcccagctccccattttctgcattaagtatttcttttccagtctgcagctgtaaaagccctcccatgcaattcagcaaagtaagcctggttcttaagacacattcagtctcatccctgtaatccatgtatattttaagtatagaaagaattcgagccaaggggagagaaggacatgaaaaggcttttaggtaatgtaatatatagttaatggcaattattattatatattattgagggtttaactaagagtagacaccattctaagcacttccatcacttgctcaatttaactgtcactataatgctacgaggtaggtattgttattaaccccatttaaagatgaagacactgaggcacacagaggttaagtaatgcagggccagtaaatggtagcgccaaagccaaatcaatgcagcctgattctagagaccaagctcttactaaccccccaccatgtctctcagtatgagaataacacttccccctgggcctatgtgaccgtggagtcttagaaggcgttcctcaaatctgctgaagattcatctgtcgacttgaaatattacattagcactgaattgggagtctctaggctggacatggatgcccccacacagccatcttgtctccagctttgtgggagttcagttgggaacataatgcaaataatgaggaatcaaaacccaaaggcaaagaccttgaaggcagagggggcaagtcacagggcctgctgagcaagtccaaggcagatgaagacaaagaaaggtgctaaagtttcagagggaagatggtcaggggcactgtgagtatgtgagcaaataaatttgctgcagaggactatttaattaataaggcctgagaccctctccccacctccatcactctatcagtgtattattttttctctagaacctttaaccaggattgtcatgttgcaaagctccaggggcaccattttggaatttgagcagctatatatgatagctctgcttatcattctctaaaattatcttgtttacatgtttagctgttgatggtcagtccttccctctccccaacacatacacagatcttccatgacagcagaaatctcatctgattctgctgaatccctagtggctcccacaatgcctgacacattgtaggtgctcaaccaatatttgctgaatgaatcaatgagtacctaatggttgaaaccattctgaaagaaggtgacatgaacatgtgggtctcataaccccatcccactccaaacctcgaccaacagattgaccaaagtctgtacaaatattaatagatggatacctgtgtcaactctggaaaacagagaaacatactgtgctgtaaccctgcatgtatttatcttagacatagtacagatgtgtccctagataatttacagtggaaaagggtatgaatgagccaagttgttaaacagcaaaggcaacagaaagctgctcttaaatatcaaaggcctcaaaacatgtcctactcacatccactcaaagatgtctcctatccaaccaagagatgaatttaaacaacaaactcaagtaggataaagttgaggttaacaaaaagcataaaaaaagattgacaatgagcaaataaaccaatatggtaatgaatttaaataatttatgtaaacatagttataaaatgaaatgcaagcgtaacaaatattccttggaacagaaaatataagacgttattcctgcccaaactctagggtagaatattccagattctactgacacaaagagtaaagttggagcaaggagatatgctaatttgctcatcttgcaagaaatcctgttttgtagtttctgtggttaattagagaaatataggttggagcatgcttttaaagatgttaagtgtaattagtaatagaatatgaaatagcttgtcttcaaaattaccaaaggggaaaaagcaaagtagttcagggaggaaaaaagaaattcaaaggaaacaacaaggaagcatggggtaggggggttgtaacgtaagatgctttaaaaaagataaaacatcagttatgacaataaatgtatacaggttaatctcccagtaatatacaaccctctctttgggacaaaacacacagctaagacaaagtgactctgaatactcaaaagtaaaggaatgggccaagatagctcaggctttacattagaagagtgctgtaatttatcaatataagtctcaaatattcctatttaattggtggactgggctcagggcatcaccgattttaaaaagttccccaggtgatcccaaattgcagccagggtttgagaactactggtggaggcaaatgtgaacaacaaaaaaggaattttaatattaatatctgatccttggatattatattacacctgactcttggatgatccttttcttatgccaagagttttctggacagctaccaagaggcatttcttattatacctggaaggagacagggctgataaactgacactcttagaacaagaatgtggccttataaagctctgtcttccatctcaaaagagtactcagacttgttgcaacaagggcaggaagaggaagtgtgcgttgtcttacaaagatctaatctttcttgctctggaaaattatgtatgcatgttgtattgtaatatttctgtaagagaataggaagagcctacttctcagtgtcgcaaatgagggatttttaaaaagttgtaattggatctcatcaccctcaatcacccaggttaaaagaaggagatcaggcaccttcctccttcagagtagtgaccagactgtgctcatggatcttgatgtcgactaaacttttaagtcagaagcgtcagactgttgacaaataataaaggtgggaaacttattaacaggtagatgtgtaattactgtgcattatattaggttattatttaacatgagcttgagtagaaaataaaaggggcttgttgaagacccctcttttattatgtttttcttttggtgttgtcaccaaacaaagagagttttcagtagtcctttatagagacctaatacaaaatccaaatatcatatttaaaacatggataatgagcccattacaaaataaagatatgacagttataatactttatgtccaaaagcatgaaagagacaaaataaaatatactaccctgaaatcaagatcaagataaaaaggatctgaaaatattatgagtgtgtatattatatgaaactctgtagtcttcaaacaaggaatgcaaacttctttacaggtgcccatggactattacaaaattgaccttacattaggctataagaaaatccccataaattctatcacaatgcaaaaactgttgggccacattttctgttcacagtacaaataaactagacatcaataagaaaagaacaaagaaaaatccataatcacttaaaaattcataaaactctttccaaataagttcctgagctcaatgaggaaaacaaagctatcaatacagacttctttttttttttttttttttttttttgagacggagtctcgctgtcacccaggctggagtgcagtggcctgatctcggctcactgcaggctccacccccccaggttcacgccattctcttgcctcagcatcccgagtagctgggactacaggcacctgccacctcgcccggctaatttttttgtatttttagtagagacagggtttcgccgtgttagccaggatggtctcgatctcctgacctcatgatccacccgcctcggcctcccaaagtgctgggattacaggcgtgagccactgcgcccagccaatacagacttcttataatgatgatgatactagaccaaagctgtagtaaggagaaaattcatagctttattcatgattaaacaataaagaaataaaataagtgcaattagtgtttatacttaaaaagttaccaaaagaataactgaacatgattaaggagagaagagagaataaacttagaaaagacaaaaacagaaaaaaaaattggcttctgaagagatcaataaaaatttctgattggtttgctcaataagtagaaatagaaaagataaatatacatagggataggaggctataataacactaaggtgataatccaactataaaagaatagtatacataacatatgaaatatggataagatggagcatttcctagagaaatttgaattaccaaaattagcatgaagggaaaaacctgaggaaactggaaaatacttagtgggtaggtggtttcatggccagtgcttcaaaactataaacaaacttgtaatagccatgctatttaaattgattttgatacaatactcccataacaatgatatgtatgatacacacacaatcatatccaccaacacaatgacacacctacagtatagaaaatccttcatgcaaagtgctagaaaatcaaattcagccctacaacaataagccaacatgacctacacaacaaaaacaacaaaactgtactgataggaagaaaaaaaatttttaatggagaggcaaactatgttcctggttgaaaataattcatattactaagatgaaaagtgtcctaaatcatggtacaaatttaacacaattccaggccagatcttttttttttctggaacttaaaaccattgcaagatccatctgttggtaaacaggtgaaaacagccgagctctccttgagacagataaggaataatagcatataaggtgctagttggcattctgagagcttcctgtatctcaactcattaactctcacagcaaccctctgagataggtactattattaacctactttacagagacagacgctgagtccaaatgttaaattaatctgcccatggtcatacagtcactgtagatgatagagctgggaagatgaaccagtcaggccagtaccagagctcaagctcttgaccacgacacctacttcctcccagaggaggaagggcttgacaacccagatattaaatactaaaacatattataaagctgtaataatataatttatactatattgacttcaaaagagagatcaacagagctggaaaagaaagtccagaaaaggaaccaaaaatatatgataaagggggcttttgaaattagcagagagagggttgattgatcaatacctgatgctagaacaaatggctagccagttaatgacaaaattaggtccacacttcattccatgtaccagagaagtcctagaagaaaatataaggaatatttgtataatgttggaggcaaggaaggactttattagtattacaccaaaattagaaatcataagggaaattttaaactacagaaatggaagattttagatttcaaaaatcaccataaacaaaagctgaataatgagagacaaatggagagaaaatatgtgcaagttactacatttaaatatttactatccttcatctatgaagaattggaatttgacagaaagatgtacactcaacatagaaatattggccaaggaaattaagaggcaaccaacaaagaataaataaagttggttaataaagaggtgaaaaaacatataatattattagaaaacaaaaacttaaaacaacagagctattgagttgggaaaaaaaaaaaagatggcattgaactttttgagagaaaggggactggcagggcagacagggaccaagcagtcaagaggtaggagaaaacacaggagagtggtgtcatacagacaaggaaagagggtttccagaaggaggaagggacatctgttttgaaagactgctgagcgccatgtatcatctaggctgaaaatgatccactgggtttcagcaacatgagactcattggtgagttttgtgagagcaatttcagagacgtggtggactcagaaatcagaatggagtggggtaacagggtactgggaggtgagaaatgaacacagcaagggtacatagacatcctgctacagaagtttgggtatgaaagagacttagagaacctgcaaggagatgagagtgtgaagaaagatactttttaaaattattattattgagacggagtctcactttgttgccaggctggagtgcagtggcgcaatcttggctcaccgtaacctctgcctcctgggttcatgcactcctgtgtcagcctcctgagtagctgggaatacaggtgtgtgccaccacgcccagctaatttttttttttttgtatttttagtagagatagggtttcaccatgttggccaggatggtcttgatctttcgacctcatgatctgcctgccttggcctcccaaagtgctgggattacaggcatgagccactgtgcccagccaagttgggtgttttttgttttgttttgttttgatgagagcagcctgagaaaatttcaatgttgatggaatgcaactggcagaagggaagtggctgaagagttagcagaaggaggaagaattatttgaagcataagattcatgaaaaggtgaaaggtgaggaagaatttatagctaaatgtattaaacagtggattgcaacccgttattagctggtcataaatttcatgttaagaaacaaaacaaacaacaaacaaaaaaatatatagtttggttttttgtctcctccaaatctcaggttgaaatgtaatccccaatgtttgaggttgggcctggtgggactcatgggggcagatccctcttgaatggcttagcgccatccccttggtgatgagtgaatttttgttctggtagttcacatgaaatctggtttcttaagagtgtggtgcccccaccctaccttgctcctacttttaccatatgatacgctggctccgttttgccttctgccatgattgtaagcctcctgagaccctcaccaggagctgagcagatgttggtgccatgcctgtacagcctgcagaaccacgagccaaatcaaacctcttttctttataaattacccagcttcaagtatttatagaaatacaagaatgggctaacacagaaaattggtaccaggggtgtgggatgttactataagatacctgatgatgtggaagcagctttggaactgggtaacagggataggttggaagagtttgaaggtctcagaagataagaaaatgagggagagtttgtaatttcttagagactgtttaaaaggttgtcaccaaaatgctgatagaaatagggacagtgaaggccaggctaacaggtcttagatggaaatgaggaacttatggggaattggtgtagaggtcacccttgctactccctagcaaataacttggctgcattaagtccatatcctagggctttttgcaagtttgaacttaagagtgacgacctagggtatctgatggaaaaaatttctaagcagcaaagcattcaagaattagcatggctgcttctaacagctcatgatcagaacaggagcaaagagatgacttaaagttgggacttacatttgaaagagaagaaaagcacaaaagtttggaaaatttgcaacctgaccctgtggtaaagaaagaatctaagcagtctgtagagcaaccacttgctagagagattagcattactgaaagggagccaagtgctaacatccaagacaatggaaaaaaggccttgacggcatttcagcaatctttgcagcagcctctcgcatcataggcccagaggcccaggaggaaagaatgatttcagggaccaggcctggggcactgcagtcctgtgcagcctcagaacatcgctccctgcatcctggctgctccagctgcaaccacagctcaaagggctccagatacagcttgggctgctgctctggagagtgtaagctgccataagccttagcagctttcatgcgatattaagcctgtgggtgcacagcatgcaagtatgaagaaggcttggcaatttctccatagatttcagaggatgatgtggagtggcaatgtggggttggaacccccacacagagtcccaccagtgaagtgcctggtggagctgtgggaagggggctgccaccctccagactccaaaatggtagagtcatggcaagcttgcatcctgagcctggaaaagcaacaggtgttcaagtccaactcatgagagcagccacaaggactgcactctgcaaagctacagaggcacagctgtccaaggccttgggagttcaccccatgcaccaatgtgcccaggatgtgggatatggagtcgagggttatgttggatctttaagatttaatctctgccttgctgggttttagaactgtgtggggcctgttacccctttcttttggccagtttctcccttttggaatgagaatgtttgccaaatgtctgcacaccattgtatctgggaagtaaataatttgcttttgatctcaccagctcataggtggaaggaattcatcttcagatgagcctttagacttaggacttttgggttcatgctggaataagttaagactttgggggactattgggaagggataattgtattttacaatgtgaaaaggacatgagatttggggagccagggacagaatgatatggtttggatatttgtctcctccgaatagcacattgaaatgtaatccttaatgttggacatggggcctggggggaggtatttggataatggggttagattcttcatgagtggcttagcatcatccccttggctacaagtgaatccttgctctgctagttcatgcaagatctggttgtttaaaagaatgtggtacctatcacctaccccacccccatcttgctcccactcttgccatgtgatacactggctctcctttgccttctgccataattgtaagcttcctgaggccctcatcaggagctgaacagatcttggtgccatgcctgtacagcctgcagaactgtgagccaaattcaaactcttttctttataaattacccagcctcagaaatttctttataacaatgcaagaatgggctaataaaggaagagcataggaaatatctgagttcaatgtaagtagtaaaggtaagtactgcttgtgaaatgtatgtttcaattatgtgcaagtgtgtacaaagttacaaggtaaaaatacatttctcactgttatgttaaaagtttttaaaggttccttatctaaagcataaatggagttatgctaaaaattttttgatgggtaatttatagggaaattgttttttgatgggagaaaggattgatcatctcttataaaaggtgggaagaatagaggaagggcgaggatgggtgttggtctgtaggcttggtgtctttagtatttgaaaattgagagtgttgcctgtgaggtaggagtaaggtgaggagaaggggctgttcatgggttcgagcagggtagtgaatgtttggggtagtttccatggagaaatggagaagagaatgacttgagaaacacagatggattgctaggcactgttgtaagcctgactgagattggtgttcatgaatttatagcagtgccaatttgtctggttgggtgattttatccagcaatgctcacccaagcagaagtggcccaatcagattgttcttgcttcagtgtatgaatctaggtaagtaaactgaggcagctctgctgattcagctattgttgagctggaggcagaggcttcacaaacccaaccttaaatttctttcacctctttctgctcagaagctcagtgtatgtaaagttgtgtctcagttatcttaatgtcatctctggcactagagcctggtgaaagttatcatttaactatgttagtcccaaagacactgtgtgagtttctcaaggtcacctgcatcagggcaaagctagttactgggcagggcttatccttatcataaacaagattaagttaactttaggctcctttctttctaaggagaatactgaggatgcagtctagaaactcacacacattccaaaaggagtatgaaggataaatgggcaatactggctgcacatttcctgagcacatgtatgtcctcctagattcatatttgatataatccagtccaaaaaccataaattgtgcccaagttattttttctttaaacaattttttagagaaaggggtctcactgtctctaggctgcagtgcagtggtgcaatcctagctcactgtagtcctgaactcctgggctaaaagtgatcctcccacctcagcttcccaagtagctgggactataggtgtgtgccactatgtctgactaattatttttatttttttttaagagatgtgtgtgtgcggggggaggggggtctcactatgttgctcactctggtcttagacacctggcttgtacacaagtttttgtgtttcttttttttctgcccagtttccacctcttggacaggtagaacttgagcatcggtgttctgagacaaattagaagggcattcaacagagctagccctctctcattcctaagacactttggttcttccataataccttctccaggttttccatctctagctctgaccgtcccttggcagtcatttgaaagctttcctctctacctggcttttaccttttgaaatatgaacagatccatttcagggtcatcttctcacttgcttgtcctctttagggcacctcatcctcacgtaactcctaagtgtatgcctgcaggaaagacatttcttctgaacgccagacctgtgtatccagtggtctttgaaatgtctccacctagctcaagtattgatggagtgacggagcacctgctatgtgtctgtccctattctaggtatgggatcagcagccaccaagatggataagcaagtccttagcccctctgaagtttacattctaagaggtgacgaaaaaaggaatgaatggcatagaggtgggctgcttttaataaggcagcaggaatggcctgtctgaggaggtggcctttggactgtggtctgatgataaggaaccaatcattctaaggaaggttcactgcagggggaaagaattacaagggcaaaggccctggggtgggaatgagcttggtgcatgtgagggacagaagggaggccagcatggtaggtagaagcagggtgacagatggagcaaggaacacaagacaaactaaagaggatgacaaggtcttctaaaaattatgagagttggatggcaaggtcttttaaaaatcatgagagtccagggatctagaactagaaataccatttgacccagccatcccattactgggtatatacccaaaggattataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaagtgatgagttcatgtcctttgtagggacatggatgaaactggaaatcatcattctcagtaaactatcacaaggacaaaaaaccaaacaacacatgttctcactcataggtgggaattgaacaatgagaacacgtggacacaggaaggggaacatcacaatctggggactgttgtggggtggggggagtggggagggatagcattaggagatatacctaaagctaaatgacgagttaatgggtgcagcacaccagcatggcacatgtatacatatgtaactaacctgcacattgtgcacatgtaccctaaaacttaaagtataataataaaaaaaaatcatgagagtcagtttggattttgtcacagcaacttaaaacatgtccacaattgaactttttgtcttcttccccaaacttgattctcaggggctaaggttccccaaacttggttctcaagggaaccaaggttctctgggacctggaatgttccctggcattaacaaatgactcagcccttccatcacccaggtataggtttgccctaggcgctcttctcactccccactcttgcttcctttatgccactgcctccaaaataaattctagtaacccaaaccctcctaccacactccagacttgaggcaaaactgtctgatgtacatccctcctggagatcccaccggcacctcaaatgcatgtccaaaattgaactctttatctattttcctaagcctccttcattccttatctccatgaatgacaacacccagttgcctaagcaaaatatgtcaactccttctccctcgctctcatattcaatcagtaactaacttctgttgattctatctcttcagtatctcttgtacttgtcacatcctcatcacatccctattaagtggaggccctctttctactgccagagtctacctggtgtcctattttaaatttcactcattttgaatccatcctccatatcggctccagggtcaattttgaaactcacaaattcttttgctgttacatccgtgcttgggacttcttaaagactccctgctgcacagaagataaagtctagactcctcgtaggggcacaaaagactctcagtgacctaaggcccttgccaatcttttttatttttccactctccccaccctcccctattgcaccctacactccagtcagattaaactacttgcagctctccaaatgtgcaaggctaatccatgtttgtatttttgccccagtgattttctttttctagaatgttcgctcctcccccacttacccttcctagctgcagtgatagagtctgtatgacaggctcattgcactcagggcctcagccactcttggctataactacactagcttgagggctgtggaataaaatcctgctgccagtagaccctgggtggccaagcatcttccaaaccaaatgctctctcactccagctgtgttggctttgtttatataatagcagcaatataacactactaataataattgtaacaaaaataggaaaatactacaaagaatttgctgtatgattggtacaacaatgaactagacatatacaggtctgccctcagggagtttatagtttagtgagggtgccagataatcaacaaataaaataagcatcacttattatggtagatcatactaattgttcacaatcatttgttctctccttgcccttgctatacatctcttgaggtggtgctctcttccctatccccattgactttgggcttagtcttgcaatttactttagcccacggaattgtgagtggacatgacgtaggcatttccaagcagaggctataaatgtacttgagtagtttggctctgttccctgaagcttctgccttctggcatgagaacaacatgctctaggcacaacgtggtccttcagcctgtgtcccagaacgagatgttatgtggagcccaggagagccctgcagagctgcagctgacttacaaccctcttgagatatgagtaataaataaatatttattgtttcaagtcattgagagtttcgggctgttgatgccacagcaaaagttgactaatacacttataaaaaagggtatgaaggaaataaaaagtgacatcgctcttctggataaggtggttagagatggtctctctgggaatgtgacagttaaggaatgatgagatggagccagtcttgtgagggacactccaacatggtgaactgtaagtggaaaggcattgaggtaggcaagagttttgatggaagagcggcatgggatgagggggagagaggtaggaaggggttaatcatacagagcttgagtttcttttctttttttttctttttttttttttttttttgagacagagtttctctctgtcacccaggctagagtgcagtggcgcaatctctgctcactgcaagctctgcctcccgggttcacgccattctcctgcctcagcctcctgagtacctgggactacaggcgcccgccaccatgcccggctaattttttgtatttttagtagagatggggtttcacggtgttagccaggatggtctcgatctcctgacctcgtgatctgcctgccttggcctcccaaagtgctgggattacaggcatgagcgactgtgcccagcccagagcttgagtttcaagtcagtgacaagtaagaaaaaaaagataaaccactatatatagcctcatagacctctgactcagatccctcttggcatggcattcaaatcaatcactgaggcccaattcctttcttggcatgaggtctttggcatgttagggtacccacgtaacatattgcccaaactggttttgagaatgaaagatggcactatggataattacctagaacaaaagatgtaaactgggattgtcccaagcaaatagggatatattgtcaccctactcatggtagcagctattcatgaaactagcttttgcttcaagttcctcattcacaactcaatcccctctggaactggaatcctaaactgaagctcattggtaggggtctgatgattgctaagttcttgccctctatggctggaccctgttacctgtatcccatagaggttggctaggttcttggtataaattacatgactgttcatcagcataacctttggaaattacccactgcctggaattaccctgtggccatgactgattcttgccacacctctggaataatgcattgtccccaccaaaccattccaggtgcttaccccggcctttaggccctcttcattgagatgtttagaggtctttcccaaggccaggctctgcactgggattttcatgcattcctcagtggctggctgaggaactcatatccccagctcacaggaaagattctgataccttatggaacaaagcacaaaaaaggcctcctgccctatgctactgggaagtagctgagtccacactcttggggctcagcttttaccttgaaaacagaccataagttctttggaaaatatacgtagccagaccaagccaccatgccaaagttggagcaaatatgaatccttctaaaaattgggggtttgcatgtatttttcacttattagctgtacgcatttgggaggaaggaagagggcaggtactttacatcattgagtctttcccctcatatataaaaatgggattaataacttctaaattacagctttgttgtgaagactcaacgcaatgaagtttgtgaaggcatggaacacagcactgtgctgggctcagggaaggtatacattcaattttggctgaatttgaaacaagagggacatccccactctgctgctgatggctgtctccacgcatgcttctgcttggtgtatctcctagtcttaatcagcctactaaggcagcaaaagtggtgtctccccacttctcccttaccacaccctcaatccagcaagaccccaggccaaaaggtttgctctttgatcctcagtccctcctctcctcaaggaatgaacaggtaactccaagtccagaagattctgacaaaactccccatttgcaggaatgactgactgctcgactgccaactgtgacctggtgaggcaccttctgtgagcagatctgtgggcagataaccttagaaaggagaggcactgtcagctgcatgggggtacctggtactgaacagcccttcacttgagtgttggatattctgtcagtcttgagtctcactgtgagattctgaggaactgtgacatgttggggaacagatggaagtcctgatgacccagtctttccatgtcccaagcaaaggctactcaaaagtgcttctctcctgtgagatcccacagctgcctgcacccagcccccaggatcctatgagtgatactcgtagcgtcctattcttcctacatgggcagatcccagatggtctctatgcccagctaaggttagcttcagctgctcttattaatctggtcagccagacacaggtattagctaggaaaaaagtatcttggcatgatgtaatccaagagctcaagccttcccattagcccagaggaattcaaggaagggtgtggatcacatcttcaacaactcaggggatgttctcaggactgtaggcccaggtccctgggtctttgaggcactcagggcctgtcctcttcacttgagcccctgagctctgttagagagctccatcatgcattctaagcctgttcgtcagagcatcctcactcaaggagtctagaactgccatggtccattcatgcctcagaccaccacccactgaagactggaaaacaatacatgctgattgttctccatgacacaaggaagtacatttggattttcttccaggggaaacacgataatccaagggagtttacaggtagcctgggggagctccctgcaagaccatgggggagtctgatctaagtcccagagcaagatgagagttgatcaggtagcctagggccaggagccttttctctgaacccacctcccctgagtcacccaaaagattgctcttgtacataaggcctagaggaagggccaatcaacacaagagggggtaacccaaggccctcttagaaagccaagccctagaaaaggtatgtagtgccttccccgaggaccacagagtctgaggacacccacatcactgagggctgatagtaatgcacatatgttcaagtaagatgacaaattcaccaagaggctcaaagaacagggttggggtattgatagaacttcaagctccagcttttgagccagcagctgtgaaaacagaccctggctggggaaactctgttggcctccacagctctctgagtcaggcatggcagagcacagtggagaatgcatacacacaactttggatattttacagagaaaacagagcctgttggcttgatcccaaaggtgaaagctgaaatgagaatgacagagatacctcattcccctataagtagaggtcacagcccaggattagactcctaaagcttgaccagttttcccagttcctcttccacgcaggtagctgtggtcctaatataccttggaccaggactcttagctggaataaggcctttgaactgggccttggattaaactgtgttcacagtttggttttggacagattcctgggttggattggactgaaatttttgcctgtgctacaatcttccaagaagacttctgaaaatctgccagttggaatgaatttttcttcctctacattctggtagcactttgtgaccacatctatgtgcaataattcagagactgctttaaaataaaagcacatgcttatcttactcactagactatgagctcttggagggcaagaaccatgtttgaatcatcttcatcacttgcccggtgctgagtgtaatggccagtacatagtacccactcccttccacattttgctgcatttaaattaaatgaaaaacatcaagttgtaatgtgggagtactggaccatgcatctcactccttgatgggataccaacatggaggtcaacatcccacggaccctgggagactacaatcatcctaataactgagttatggcagctcagcctggccaacttaatagcaacagcatatgaacacaacgtatcaccacatgtatcacaaccccatgtatcttggcatgacacaagtattagctaggaaaaaagtctcttggcatgatgtaatccaagagctcaagccttcccattagcccagaggaattcaagaaaggaattcaagagacaaattcaagggaccaaacctcacagaactgacacaaaactttccccaagcaactggcatacagtatgtgttccatactagttgttcagaaatatgacctaatgtctagatcatctaggagttttttagaactacaattcctaggccccattttggacctactgaattggaattttgggggacaaggccaagaattttgtattttaaaaggcctatgagtgattctaatggttagctgggtttgggtctactttagaccacgcagggccaccaaagacacttccttctcctataaagtacctgactgtttaggcataaaggaaacaagtgatgtatgtgactcacactggcctggcagggaaagtgttgactaattccttggacatcctgataggaaatgctgggagcctccttcgtgagccatcccttcagtctgcctgatttcaccctggccaggtacactgaagagctggatcccacgggcttggttcttacagccagattctaagccaagcccagctaagcatgatggtactttgggaagttctagtcctacaaactgttggggtgagatgtgtgtggctgcacagagccagtaactggtgggcttgtgagaagcccagcatacatataggcccactcagttttaggatctccctctcctgctaacccttcttcaatatgtatgccccagtccaaggactgggcttctattctggttcatggtttcctctctagtctctgctgtgagactgaagtctctttttggagactgaagcctttggatgggtcaaggatatactttgccgggatacaccctattcccttgggtgaggacatgagtcaatccagaatcttccttcccccataaagtatctgcctatttgaaaacaaaggtaacaggcaatgatatgacccatactggcctggtaggacaagaattgactccacctccttgtacattctgagaggcaacaccagcagcctcctttgtgacccattccttcatccagggtcagctctttcagccctggactccctcaactctggcatacacttcccaggctgccccatggccctgggacgcttcatagctatgactagtgcccattctccagtacagtagcagatacagaccctcccccatcctgctaccacccctgactttccactcaaggcgacgtccccttcagatcactgggagaattctgcagagcgggcaccccctgctctgcctgccactagcaaagggaaaccacaggtcttcagtgttcaggttcttgaggactggataacagagggagggagacctgggacttcctaagttccctgtttattttctggggctatctgtaggtcaatgaaaccttgaaagaagtctagagaaatgaggggaatgttacattaagcagaggaagctcacaccgatcacggtccctggcctaatcacaaacagttcccaggaatattatccctcatgctgaggctgatgcatttaaatctttgctgatcccaactctggctctgatcatttgaaaaaggcaatttccaaggactctagctattgtgatcatattttctgggccaagggaaatgatgtttgaaattgcatttgtcctggaaaatctgggattgtatgtttacagggaacactaggtttcagccatagaggggagggaaaatagagcatgcttcacctgtgcatgtggcattgaggtcagggtgggaggagaaatgaaaaaagtacctgcctatttaagaataaaggtgacaagcaatgtatgcgaagcaatgcatgtgacctatatgaagaaaaccatggagctgttatatttagaaagacggaagtaggcgaacaaaaacatgtgtctggatatgagggctgtgtattataaaaatgcctattttcttcaagttaatttatattttaacaggagtgcacatacaaaaatcccaataggatgttttttttactctgacaaaatgattctaaaattaatcttgaacaacaaacagatgagaataacaatgaatattctgaaagagaaaataattcagggaggaaggagttgtttctagctctgccagatattagaacacattataaaacaacaattaaaattattcaataccagtgctaagatagaaatagagcagcagaacaaagtggtgactcaagaaatagacttaactacatttgaggattcagtatgtaataaaacaattcatttccctcaaatcaaaagggaaatgaattacttaataaattgtgttggaaaactgcataatagtttggacaatattatacattcatctaagtaaactccagatggagtaacaaattatattttaaaaaatcaaattactgacaaataaccaaaaatagaacgaactgtttctcagatccatggcagaataactttgtcagctttgaaaataaatcacaaatactgagagacttgtttatatagaaatgtaagacaactatacaatgaaaaatagaaaataaatagggaaaatgaggttgggaaaatacatatatcaaataccacaaagaatttctatacacaatgtagaaagaatgccttcaaattgggaaagaataccaacacctcagtagccacatgtcagtaccagtagtcactatacagggattggaaacagcaaatgccccatgtccctcctagacagggctggaaccaggtcggctgaagaaaggccaagactgaagtctctatccagtgccctgtgatggcaatcttggcagtcctccagacacctcttttatacctcttaccccaacagggacatgtctctggcccatggctacccagcagtctgtctccagactgtgctcccataaacccacctcccttcttcattcatatccattaggcaacagccaacccctataggaaccattacaaacccaagtacccagtcctgcagtgtgggcgcgcgtgtgtgtgtgggtgtttatgtgtgcgtcaatgtatctacggaacatgtcccttttgcataggcccaaacccagtggcttctcccagaacccactgctgcctcttggatgtctccttttccagcagggcctctcatctttcgggcccaaccattctaacagagaagatgtcaagtctatgccccatgagaagaggggctgttgctcttctgttcagcacccactatgatgcccaccacattgcaggcactcaataaatatgtgttaaataaaagaatgaacctaatattcatagcatcaatgttttctcattgaaaaactaaattataagccacaagggcccacttcatttatataatggtgtctatctccacatgagaagagctccttgaggacacggaccgtgcccaattcatctctgaattcgtggcacttaaccttgggcacttcacagtagtccacaaaggtgtgctacagaaatagattcaacttacagctattaaattagcaacttttaaatggccacacaaatatttgaagtttagtgaagctaacaaagtttacaagcaatatatatgtgacctaaacgagaaaaccacaaagttgttatctttagaaaagtgaaagtagataaacatgaaatagaggcatgccatgtttctggatggaaagaccatacgttttgagtcttgttcttaatcttacagcttttgctactggcattatgaaccgacaccatattttggggaaaccatgcaacagtatgcatcaagagtcataaaaatactcatgtcctgatcggataatgtcaattctagaaatttattctaaggaaataattcaagagaagaaaaagccataggctgaagatgctcattatagccttatataaaataattaaatataattggttgaataagtcatggtttattcacttgacagaagaacccacagatttttaagaatgataactatgtagcaacatggtaagattcacagcagaatatgggctttaaaacatagaatgcaaaatggtatgctcactctgatgaagaccacataacatatgtgtatagatgggtaagaataaaaaaagactggtcgaatttgaaatcagtttggtttaagggagagagaatatgaatattttctttatttaaacttgtagatttatttaaaccattaaattagcttaaacttgaaaaatatgagaacataccaaaagtctctgtcaagtattggcccttgagctccagatacgtctagagatagagttacagcacattatatagggcatgacaccatgagattgtccctttaaccttagcaggatcatccccaaaggcccttcagtttagaatttgaccaggaacagccataccctcttatgcagctaactttgtacatagcaggtactcaataaatcaagatggataaataaatgaacgggtagaaggaacagagaaaatgtaaagattaggaagaggtttcaaccccagtatattgtatgttgggggtatacaatattgatagatttccagtaagggtcacaaatctacctttcttggatttgtctaactcctgtcaacctttgttgcttcatacaggtaactcggccagcagtttgcttctatactctggcctagtatttttatcctaaggcttccttgtccttacatttgcagatgatccctaaacttctagaaatctagtgcaatggagacagggcaagacttgcagcaagaacctgggtgcaaattgctgctctgttaattaacagctcaaattccagcctattatttagtggttctatgaccatcgtgttagttatatttctttgaaccttgttttaatctataaattgagagaataaataccctataacacagtagggaggactcatatattcccaataatgtagaacatttaataaaattggcattctcctctaacccatgccttcccactgtcataatgctacagactttaatcatagcctcacttaaaacacaaatccataggattcttcatatttggaatttgacaaaactaagttatcctagactagtcgttcttaatctgtgatttttttcccccagggaatatttggcaatgtctagagatatttttggctgtcacagctggtgtgtggggcgggtgctactggtagatgacagagatgtgttaaatatcctataatacacaatactgccccacacaaaaagaattatctaggccaaaatatcaatagtgctaagtttgagaaactctactctggagtaatggtccatgggagagaccagattcttgcagatcccattacccaattcatcccggaatgtgtgcgtgcatgtgtgtgtgtgtgtgtgtgtgtgtgtgtgtgtgtgtgtgtgtcaccagaacagaaggtgggataagtaaggaggaagtcagagtaaaggacaggaagatactagcagagggccagtagggccatttcccacagcatctctgtgggccatttcccacagcatctctttcccttccaactctccaaaagcccagctcaagtcttgtatcttctgggacattttccctgagcacccaaggatccaattttccctcccttgacctctcaagattagattgctgatttgtaacttaaatcgtatacatccaagaagttcctgccttcacatttcacacatatactatacacattaagaactgagcaattaggattcacatcttcttaaggtggtttacaaaatggcaaaggaaagtgtgcattcatgcattcttggcatatctctggtgaaggctgttttgaagcttcttttgaaagtggctgctaatggattgataattggtttcctggcttccttaagaagtgtgaagcattctgccagcctgtcgtcaaagcatcaagtattgtgcaaaccaccatcagagttatttgtatcttccttgccattgtatctcttgtggtggaagaatagctggacaagattgtatgggaaatgctctctattcttttgtaaggaaggaagtaaaatggcaaagcttctggaaggtaaagaatatatgcagcctggccaaagctttcccaccatgacagccaggatgagcaatttcctaggcagagactgaacaactctgaatccaatgcatggtgctcagcacagggaagacaggcagtcaatagcttgaatggatggaaagtggtattacttcccattgattttgagcaggggtcccgggagatgtgaattaactgaggaccagagagtaagagcaaagaagctagctccaccttttctttcaaaacgtttttcactgtgagataaatcatcttcttaaaaacctaaattaaaaaaagactatctattgagcatctactactgtgagggcagctcaaaagccaacaaaatgattctgaagtctctgcttgctacagaaaatgttttggaacatgaaggaagagtgtatttgtgtattcttggcagggtaattccctagtaaagagttgttttgaagaaaatgtttcaagagaagaacaatacaatactttgcacctcttcagacaacttctcaaataaatttgagccattgaaataatatccccaatccccttatagctctcaataaggaaagggcaatgttatttgccaagtattgtattaatatttattgtgactaatgtattggaaaatttagggcacttatgctgacttttgctagaggagcttttgtatgtacatttatgagcgctttgtaaaacacagagaccaaccttatattttatatttttatagatgtttataggtattgtcccttttctattgataacattatatttgatctagagttaagagcagaactccaaagtttaacattgtctctcaatcgaagtatgacctgctctgtaatgatccactttcaaagtagcttccaggtatttattgtgggaaatgtgaggactattcatgtcatagtcatctttttctacaaatatgatcatagaggcttagaatatttggagccacaatggagtgctaccctattggataggtcagtacatgaaaatccagagagaagatgcttggctttagccacaaagctgagctagaactaagaacctggtcttcagattttgaaaccaaagtcatctcagtgtaccaggcctttcttatcaccatactttcttatcaccaattggactatgagctccctgagggcaatgcccaggacctataaaagcatcagcttacctgctgggtactcagtagggagtgggcagatggaagtccctcactttgttgaaatgcaagggtgacctggctatatgctgcaaaggcatggggccggttggctccctctggcttcctccatggaagccagcatccctgagattcaagctgtgtcctcttactctccaatgtccagacacacttgagtgatggaagggcctggggatgtcatcctgctctatcccagaattgtctagaagaagaaatgccatgtcagctccccagagtacctgcttagctttcatccataagcctcagacccctcatccttgtttcaaaccacagggagcactgacacatacttgttgggacagacctatcttctttccttctcagctgtttgcaagcagtgcccagctcactggaggctgccggccctgcttgtggacaccaagggcctgctgggcagcacttcaaggtcttctgcccttggtgaaggttttacagggatgttataaacctgctcctaagagccaaagggccaagtaaactcttggaggggtcaagcaacagtccctcagctggcattctgctacctgcctctttcagcttgggggacagtgaatcttatcctggtcctaagaggctggctggttttgcttcccatgtgaatcctcccagctctttgtcgcagaagctagaccctcctccatttctccctgccttgttttatctagatggatttcagagattaagcccccatggcacctggggctcccactgtgtgtacctttatcttctcaggccctgcttctgcagagccctgccccgtgcacctgtccctgggcttggtctctgcaatgggcaaagcctttgtgtttgcctgccccgagctgctccctgctcctccaggtccttgtggctcccagcatgctacgtggctaatgctgttgggctctatattctaaccacagtggggagcagggatgggcagatatcatgcaatttatttttttttcaataagggtgagttgttcaatgtgtatttaagggtgacttgatctttaaacctctcaagactttttacataaataaactcaaaagtcatcaaaatgctttgttggacaacgtgatttttttttttcatttaaaaagtatcatcaccatggttcatcccaactcatcaactcatacaccaaactctcagtcatcacagagaccctgacagtctcccaggctattcctctcccagccctgagggatcaccgatctctagtgtgcagaactcgaggccccaagtaacccactgagccgggtgaaggatctgagggtcaggctgcctgcctttccctgagagaagcacatggaaagagatggagaaggtggagtgacaagggatgggagaagacgtaacagcccagagaagctggaaattttgatttcccacagagaccatgtctgggcctcccttggctacacacagcccctcatccttgccaatcccaacgcgactgaagatttaagatatcatttgtgctgcaaagtatggtcaggtcatccaagaggaaggaagaagggcttctttgttatctccacagaacagagcactcaactccaaccccttccccaaaagatcaacagtccaaagatagcttgatcccttttccctccctaaatccaatatgagataaagcaattttaggaaactgtttatatcctggcaaggccagtttcccacagttactggaggctggtggtgtctacagccttacaaacttgacagtcccttccaccctgctggattagatggtgtcaggggtggcaatgacggtgagcaggaaatgtctgggtctgagcctggtgggctttgtcccagtggtgtctccttgctcttaaggatcaccaagaagggtaagacggtgttgaagagcatccccaaatgtcaggagcacttgttctcagtgctacagtcgacattcctgccagaaataaggaccccaccagcaacgttccgaggagtagaataaaccaaccagagtgcagctgttgttacaacctgcaaggttcccagggacggggcccctggattagctaggaaacgggcccctgcctctcagtgaagaccctggcgtggcctcctccctgctcacttacacacgcagcctggcttcttagccgaccattggttattcttttggcatgtgattgccttctgtcccaccagctcaaaggcgggctggcactcaaacttgagtgtgtcaccgtggtgaaaccgggagccttccctccggccatatgcaggtatgccagggtcaccgcaactgccctgctcgatctctgaaagacaggaagatgagaaaacagagacaaaaggtgactttatacctcttttggagctgaaggtccacatgacaagctctactgctcttctgccataagtcagtgctcagagtgacacaggtaggattcaacgttcttataaggaatgaggtttgtgagaaatcctgcaatgtcctgtttcatcgcagcatcctaggatgaatgggcttccagctatcaagtgcctgagactctgtgtccacataaagtgttctagatgcttggatgttttgatcccttacccctccctaaatccaatatgagatgaagcaattttagggagaaggtgggtctacattcttcacaggttacctgtcccaggagcaacaagttccacagcattagaagtctttggagacttcctcactgaacctgaccttgcatctgaactgctaatgtcacgacagatctcaagtacagtccatttctgagcagcaaaggcaagtcaagatgacacagcagttgaggctttgctccctgtctttttcccaaaccagagattaattgagaataaatgttcactgcctgctgatgtggaagaaccttcatggagatgtttccttaattcaatttgcaatggtagcaggtaaaatgaaacaaatgactcattgagtatgctttgaaagttcacttgagtcaacagtggtgagacagacatggagtgggttccctgagacagctctgggggccctgaacccagtgggcatgatgggctggctacctcaccggagaggcagtcaggatccagatgcttctggaaaggagtatgtcctggccaagcctctggagcttcctctggagtcacctccactcccactcatgctgtgcttaatgctgtgagagatggacgaggaggagggggtggtggaggggaggaggaagaagagggaaggaggggagctctgtttccggggagaagggcgtcctgcaggatagacaggaggtcatgaagccagtgccagacggtgaggtgaggactgtatgagtcccgagatttgggagagaggggcccagagtcatcaggggagttttttggacactacctaggattctcaggaaaaagggaccctgcctgttcggtagacaccatcatgggctgtcagagccacagtccctgaagttggtgtgtgtgatcctgacagggatgattctgcaaaggctttcctaccacactgggggcttctgtgggctgggcagctccaggcactgccttttatgggcgggctcttgactgttgcattcatgttaacccaaaacgaaggctgccagctttgtgctgagagcaggcaggacaaggcattctatggctgggattgtgtgtgtgtgtgtgtgtgtgtgtgtgtgtgtgtgtgtgtgatcatctaagttgaacaacaagggtcctcccctttgtgcaggggagtctgtgtgaccatgtgccaggtgtgaggcatctcaaatcaaatgtaagtcagcccacttgcctctcacctcacatgtccccctggcctcaccctctacaagtacatctgctgaaaacatagctgaaacccctctgaagctggctttgctcaggctcagggatgggggaggggatacactgaggcattccaggaacatggtccctttgctacaggtcccagagctccagggaatctgaaggaaagaaggggctcctgtgataagtcaacgtggagaagcaagcagcaggacccacctgcctccagatgtccccagacatgctctctgggatgcgagagcctggggtgtgagggctgtcactgcaggcattttgagacctggtgaaagttacacagcatttcaagacagagctggatccttcctgctgccaggggcagaacccagatataaggtttcctagtgaggccccaccattgctgcaggagatatgcacgtggggtacatgtgcctgtgttcctgcccacagcagctagtctgaggctgtgattggcttaagaaaaaggggatcctaagggggatgaaggaatctgcccagccttcccatcgtgtaggcacagccctgcgcacatgcccacatccacccacccatcacttcctcctaccatcatgcaatcacaggcacccacttacgaacaatgcaatgagcacctactatgtgccagttgctgtgctagacccttgacatctggatatggtctctgccctcaagaaatgaacagacaaggaaataggtgtttatgatacaggggattcgtgctgtggatgcacataggagaagcacctaactcaaatgtggaggatcagtctggaaatagggtgtggagaatggaagtactaacctcatctacaaaatttcaaggggcgccaaaatctcagttatcatgacaaataatatcttagtgcgatatttttttctagaaaattacaattaatgccataaatccaattcacaatgaagaaaaataccaacatttaaaataaagcctggatccaaccctatgctcagatcactcacctcactggtcttcaccatagtcccagcactgtcagagcctgtctttgattcaaatgttgatgtgttttaacacggatattttgcactaatattaatttttaaaaaaaatttgcattaagtgttatttatcttaattgctgagtttttttttccccatcacttaaatttcgtgcccatgagtgccctgctcacctgaccctagtcccagacctgggtcaggaaaggcttcttggaggatgtggtcctccaataacccaatagttattgtcacagctaactttagttacataactaagtgcctggcctgagcacttgggtgtaccctcactgagacaagaatgcagaaagaggtataggtctgaatggagggtcatcagtaggggatgctgagttttaaggtactagtgggacctccaagtggaaatatctagcaggaagtggctatatgggtcttaagttcaagagagaagcctggtctagaaattcagctcatagattgtaaaagaagccatgacaaggatgaaattacccaaggagagtgagaagggatgttggtctaggacaggacagttaggaacaatgtagggaccagcagaatgctagactgggagagtggggtcacaggagcttaaagaagaatgagtttcaagaaggagatcaacagccttgaatgctgcagggaagtttacataggattgaaaaacaggttagcaaaaagaggtcacattgatactgccaggattgtgtgtactgatggggccaataccaaacaggagaagagaaggtgatatcactctctctagagaaattaggtagcagctcatgaggcatatggcctgggtgggagtggttaaagtagtttagtacaggagaaacttgaccatattgaaatgctagagaagaatgaaggggtgggaggaaagatgtattgaatggttagctgaagatgtggaggagaaaggggccccctacaggggctccagagaaggagagaggcatgggactgagagcacactagaggcccagccttagagaccgtgagggatgtccttccctcaagactgcagtaaagagggaagaagtggtggcagtgagttttcaggtaggatggcaggagaccgagggagatcctgtgatgacacaggctctattttctaagtggaggaggtcacagtctttgctgaaggtgagggacaagtcatgggaaaacgacttgaagagaatgtctgaagctgtcactctggagaagaggaaatcatgcctagatggattgccatgcacctctggggcccgccgagggtgcagatgactcatttgtagggataccatccagcagggctatatgacttgtcccagcagcccttggccactcagttcctgtagaagtagagaaaggggtaggaggattgactgagtgaggggggattgggcttggagaaatggaagacaacggggcaaaggagctgaacatgttgttaaaaagaatggccaaagtgttatccaagaggcttagaatgaagaaggaaagaggtgaaaggagcagggggcgatgggggaaatagaggatgggaagggatgatgggcaggagtaaagggagtgtcatgtgaaaaagctgaagtatgtggaattgagatttcagaggtgcttgatgatgaggtccagctgcagccagggtgaagtacactgaaaggaagtgagaaggtcaaggcctgagaggcaaggtgatggcaagtagggaggaggagatcagtgacagtgatgaggaggggtagaaagtgtcagagctgaagacagcataaggtcaaaggggaaggggtttacacgtgggtggaatggcatcggcgagcaagcatacgagcccctctcaaggtgaagttcattgggtgtggggaagtgagctgctagcactgcagagggctacagggtcgtggtgacttcacgggaactcagattcaaggaagcatttggcaaagagttctaaggcattgggggatgtgttgctcagagaatcaagattgggtggaaggaagaggaagaacagagcagggtggggtgagagtttgggagctccttccaggaaggcagagggggctgctggctggcttctgtccctttgacacctcctgtcctggcctaagccttctctccaagctcagagtcaactcctgctggaaacacagagaccacggccgctgccttcctgcaaagggctccctgtgctccactgccctgcctgaaaggtgtttgatcttggcacttctggtcaggtgctgaccaagtctgacgtcaggacccagaattgcaaatagacaaatggattttgacttgcagaaaaatcacacatgcaatttcctgttatctggtttaatataattccgttttatgagtgtttctcctgtctctctccttttgcctaccaaaagcaaactggaaaacatgagatgattgcttctaagatgcctcagaagtccatcatgactgagctctgccactcagcatatttgcttcccctttctcagctgttttatccccatcatctgtgatcaatctcactcttctccccaggtttttccatttctaataccaaattggaatcgtcttttatgaaaatgtctgtacagaagggactgtatcatgtggttctgtaaattcactgaatatttgatgtgctccaagaggggaggcactgcttggaggaagacgaggatttgctgcctttcacatgaggctgggaggcttcactggctccttcactaactcattattcccctggcttgagcttcctctcctcttcctttggcatgactaacgccttgcattaacagactttggtttacaatgttacctcctccaagacattttccttgaccacacaccttagatcttagacatttcccttttacttttctttctttgcaccccattctttttattttttcttttgagacagggtcttgctctgttgcccaaactggagtgcagtggtgctatcacagcttactgcagcctcgaactcctgggctcgagcaatcctcccattttggcaccacattctttccctttatagcaatgatgccccttgtaactacccatctgttcattcaacaagtattttactggttactgttctagacattgggggtataacagcgaataaaaggatgaaaatttgttcttctggagctctggttgggcattgggcacaagatgattcaccacccagcccccctcactcccaccccctagaatgtaagccccatgaaggcaggcatccattatgtatttttgatcactgtgtacccggcacttagcacagtccctggaacacacagaatactctgagcttagcaaatattttgcatggaaaccgtgccaaatgccacactaagcactaaaggtatagcattgcctgccccacggcccctgcccctggagaactcagggtcaggtgggtatggagataattccaatacaaatgaccagggcaatggagaggatgtagacctgaccacatgacttgggtgatagcagaaggggcagctcaagcctctggctgggagcgctggacaggtttcttacaggttgttcaaatctgggagtcagcctggattgccctgtccttctccctcagctctccttagtctcctcctgttgactcctcctcccacatacccagaaccctctgctatccaccccgtctctccctgcctgagttcagcccttgcaactcctcatctgggtgccagtagcagcctatggttcccctggctcttccttctatttcatactctacaaaggagcacaagatcactcagaaataaaaatatgatgattaccatcccctgctcattgatccttttacagcttcctgaaatccacagactaaaatcctaactcctcagcatggcaggacccttgcctacccctcccaccccagcctgctctttggccatcagcgaccttgagatttacacggcacagcaatgagtgatctgtagggaggtagaatagtgcagtggcaagagctctgggatcacaaagtccaggatctaaatcctggctctgatactaaggaacagaccttgggcatgtgacttattttctctgagccttagttttgtcatctgtaaaatggaaatggtaataacaaggttgttgtgaggattaaatgagcttctgtacacaagataattgtcaaaatgtccagtatgcagtgtgtaaccagtgactaaccatatttcctcagtgttattgtcgctgctgtttgcagagcccagccgcccctcagatggctgtaacgtggcacctgccatcctctcttcccgaaatgaacaccctttgctttgtctaccagacaaagaatcatctttcagtgttggtgcaagtgcattcccatgtgggaccttctttcgaatcgcccaggcagacttaggagctctttctctctcgctcccagcccccttggacatttctgttgttatagcaacgggtgctgcaattttgggcgtgtgtttcccactgttaattggtaagttccttgaggaccgagccaatgttttttgaaatgtctatatcccagcttttctagtgaagtgcaaggcacagagaggggattcaataaacttttgaggcatgatgggggaggatggaggagaggatggaaggaaagcagcaggaaaggagaaatggaggacaacagcgtagagtctagagaagagctagaagctcagtgtagtgggaagctcaagtgatgaagagagaagaggccggagagatggttggagggagaccctgaagggcttggttcgatgagtaataagtcatttaagctccatcctgtgggttgtcagctccctcagagccaggggtcgcatcccttccactctttgtatctccagaaccaagcccagtgccttatgcatactaagtgctcagacctgttgttgaatcagcacaaactcctagtgagtgaccaggacatcttcggtgcattaggaacaccctgtgggcatgcccagaccacctggattgcctcagaaccacaccccactctgcttttctacttctgattatgcgaagggcaccaggaggtgagagaccccacatctgtatgtgcacctatggggactgatgtgtttttctgcacacgattgccacaagtggaatggaggtatggctggatgaagtgggtgacattcttccctccccatctccttcctctataacactgtcatgggtttgtcaccagccaaaggaggctggaaacaaaggacatggaggtagcctccaagctgtctgcattagccccaaactaaagcttaccgtttgcaaaagctatgtatttagagagcacatctcactgacaaattactttctaccaaattttaatgcggcagcatcctctgctgtttgccagcccagcctccaggggctagaacaggctggatcccactgggactttttgagaagaggcagctgctgcttgtatctagctcaactttggctcccagtgcctgaaaaacctttagaggtatcatggaaactcagcgggcatcttaggaacatgttagtgacattcttggccaaagttggaatgtttgggccttccagtttatggggaaaagacaagaaatagaggtgtactgaaaataacagaagagaggctgaaaatagccatgtgcttggcatctgacaagaggaaaggcggtgtcctagagggagtggtgagtgatgctggtcggctgcccttggcctcctttgaagtctgcttctaaaaccacctcttctgggggctcagcagtgcccaccactggagtgaagttctgaagaaggggatgtggcactgcctgcagagagcaagtcttggccctcttctccccaacttgctctcagactttatttttactgaggttttagcctcaatcttatctgcatgtcagctttctaagcccacctgttccctctctcaagggagtctgacaaactctttttcatccttcaagcaagtctcagtttcagacatcacctcctccagggagactcccctgatgcccttgagcaagatttgctgcccctcctttgtatttccctgtcttctagcacttgttctatgctactgaaaatggactatgaattaggtgaaggcagagattgtcttgctgtccttgtagcctcagtgtcctgaacattgtctgcaacacatcacagggccttagaaaatgttgaacaaacagatgagctcatttctaacatgagtgccctggactgttgggcagcccctctgcataatctctactgtcctgctccttcatgtctgtagggtccaggtcccagcttcttcctcccctgggccagcctcccagactcagcattaagctgccagattccagactccagtaaggaagcaaggagacttccagattgatgctaaaacttgttagcaagttgtatgtaattttataatgtttctggtaagtgctaattgcctgttccttaaatatttcttgttctactgggaagcaaagaaattgcaactatgactgcatttcccacagctggtcgcccccatggagggagactggctcagagtgctcagatattgacagatcaggagtcccctcccccgccccctgacctgggattgtgacaagcagaactggagggatttctgggaagcaaatgccccaattttcccaccaggttcatgctttcaatgaggaagaaaggatgatactggagtgccacctgcctgcccctaaggttgtatctctctgctcaaattgggacagagtgggtattgatgatgatgatgcagccagatgtgcctaagggatgagtggaaatgatggatatgggaggtctctgcccttggatgccttatgccatcctacgagaaacctgcatcacagctacccgccccccaacccctgctcgttcctgagtcgagatgtctatcctgtgtggaactccccaggagctggaataacaggggctaaaatggaggcagaggtaattctgaagcttcaggtaatgatgtaggttggaagaagagctgtaggccttggagagcagagaagggagtaagcttccaactgagcatttactaaatgtcaggccctatgctgggtgcttgactatactgagtcctcatgagaccctggaaagataaccattcatcagcccctcttcacaggttaggaaattcaggctcattgatggggagagactggcacacagggagtcaaaggaagatcctgattataagctgggtttgcccaaccccaaatcctacagggacaatagagaatgcatgggctgttggcatctgtgcactaggaaggtggtaaagtggaccaaaagggaattgagagggtgctgaggagggtacctgattatgactgagtagatcctcattacaatttaattctacatgcttttctgagcatgtgtcctgtgccaggcactgaattaggctctacaggactgcagagatttttgtcttgaatggattcgtagaaaccagaacttggtggaattattattatggagaacttcggatgtcatgtagaaaacgttatactttatcctaaaatcaatgggaagttgtcattttttttttaactaggggggaattgtgccagatttggattctgggaagatcactgctccatgtggcagatgggtagatgggagtgagaggactagagccagcgatgctggttgggaagactctgccactattcaagtgagaggtgatgagggagggactcagctcagcagtgaaacagaagtgggatgcggaaaactgacagaatctgggaatggagtcagaggtggggagagggaaaaggaggaggcggagatgaggcctagggatggcatggatggtggtgctgttcgtgaagatggggtacacaggtgcaggtcacaggtgtgggggcagagatggcgagcttggttttggatggtattacggactgaacttgtgtgttcccccaactcccccaaattcctgtattgaggctcttagcccccagtgtgactgtatttgaagatggggcctctaaggaagtaattaaggttaaatgaggtcataagggcagggccccgatctgagaggatggatgtctaagaagaaacaacaccatgctcattctctcattctctctctctctctctctctctctctctctctctctctctctcctgtgtgtgcatgcacccaggaaagcccatgcaaggccatggtgagaaggtagctgtctacaagccacgaagaaagccctcatcagaaaccaaattggccaaatccttaaccttggatttccagcctctagaactgggagaaaacggggtgctgttctgccttctctagacacatggcctcctattaaaacagtacaaccgttatctttaccccaggggacattgtggtatgacagtgttagtgtaggaaagatgggccggccttctgttatggggtgctctgtgccccccaaaaagacgtgttgaagttctgactccggtacctataaatgtgatcttatttgaaaacagagttgttgcaaatgtaaaccacccagtcttttttgtttttgtcccttccgcctttgactttttatttgaggggcgaagcccatcattctcacaccctcctggtgaggagctccctatactataaaaaggtgggtgggttgagtccccggcccccaccatgtgactccctatcccagggcattttgttgtcagcagactatacaggtgggtgggtttgagacagctgagagggaagccatatcaaaatgtgtaacaggaagactgaaatgcaagtggagaacagatgtggaagtcaccagagtttgggttgaggctgaaaccatggaagtacacgtgatcaactgcagaaggttctagaataagaggactgaaggctgaggatagactctgaggggcagtggggagccatggaggagctgtgaaggagcagccagagaggtaaaagaaaaccaggaggtggaggtgataggagcccaaggagcaggatgggcaaggacagggagtcacatcggggtgccggggactcaacccacccacctttttatagtagagggggctcctcaccaggagggtgtgagaatgatgggctttgcccctcatataaaaagtcaaaggtggaagggacaaaaacaaaaaagtggcccacccaacttagccccttgaattttcactgagccaggttccaacgcactgtgaggcctccaggctcctgcgagcctgattctgcctcctgccacttctggctccacgccctgcactgaggccttacagagccacctcatttctctgccagtatggggagggagggccctaggtggggagtgctggtgtaaggcagggacctaaacccagggcctatcagagcacctggaggcagatccaggtgcctggcctggaggacaagaaatgtggaaggtttggctggagagaaactttggtgacacccccagggaaggcaccatctctatgccaggcaatgtgcaaggagctttgagatctcatttcactctcctaacaacgctctcagattggcatcattatttccattgtacaagtcggggaactgaggctcagagagaccacaagactcaagcttacacagctgggaccacactgggatttactaggtctggtgcaatttcagagtctgtgctattttctagaatccactgcctctgtgcacagaacctgacgtagtccctgtgggtttgccatgtctctaaacacccagactgtccttcctaatttgtcacggctccaaggagaagtcctgctgacacctagtccatgagcagcattcacatagcatatgctttataccacatccaagctgctagctattataatcacagcacccagcaaaatgttggtcacataacaaaagcttagccaatactggctgagtgaaatggacaaatgaacttgtgaactaactccccaacctctggtgacatggaatccaggctcatgatacttggtctatttgactggggcaaagctttggcttctattaaagattttataaggaattgaaattatgtaaccttgggaggcttctggtgcaaggggaaaatccatgggcttctgaagccagggagacatgggttcaaatcccagctctgctactttccacacttgtgtgtgacctcaggcagattacttcacccctctgagtctcagattcttcatccataaaatagcagccattttatcattgtaagcaatgaatgagatgaagtaatgtctttcaagccagtggttagctatgaatcctctcttaaaagaaggcttacaaagagcaaaagagaagaaaggagaagaaacagaggcagggtggtcagaaccctccatcctgggcatgccctatcctaccatggaggtccctggagggtaccgcaggtctttgcaagacactgtgaaaaccctgagataatgaacataaagctatggcacatagcaggctttcaacaagtggtatgtccctttcttttccaacaagatcacaccaaatgcatctaattcctctttcccacatgaaagcccttcagatatctggacacagctctcaaatctcccaagtccacttcttctcctgcataaacattcgggggccatcaacatttcttacaggaattgccttaaatcctctccttatctatcccaagctgaggtcccacatctaagctcaattctctggtgcctgctcagggcaggataaagcacaactaacttcctgggataaattccagtagctaatttctttttaagtcttaaatcatgacttgatatttattcccactttatcttttcctactaatttagtcaatggctctaccccacccagatctttctgcactctgtttgctgactagtattgtcatccctttcaagttcacgctatttacttcttattcaaaccgttggcaaaatatggacagattaagggcatgaggatgacatggaatcatttctccctgcttttgggaacattcactgctgaacatccatagaatttctgaaatgggtgaaaacttagcaactttgcatccatctccattccccttttcaaagtagtgagtgacagggcttggacctgaatcaaggtctcctgatagttttgtctgctgctcctctcatagccccacagctgcttatgtgtaactttatgcaccggaacagcccgctcattgaactacctgtgtactggctcattagttactcactaattgctttgcaatttgcaacatttcttatgttcacatttcttaatctaaccatcttcacaggacccttgagacctaggttgtattattatctctgtttcacagatgaagaaacagatcctgagaaaggttccatgacctgccatggagctagaaagtgacagaaccaggatctgcactcagagtctgtcaccccataagtattttctgtctgttgttctgtcttccctagacacatggcctcctattcttaaaaaatctcagtatagctgtcatctttaccccaggagacatcattgtatgacattgttagtgtagtatgggctagcctcctgttatggggtgaactgtgttccccaaaaagacgtgctgaagttctgacttctggtacttataaatgtgatcttatttggaaacagagttgctgcaaatgtaatcaagttaagatggagccatgctggagtagggagggcccttagtctaatatgctggtgtccttataagaagaggacagagagacacacaggaaggttgtgtgatgacaaaggcagagactggagtgatgcagctacagccaaggaacagcaaggactcacagccaccaccagaagctagggagaagcaggggaggattctacccatagtgggggcatggccctgctgagccttggcgtcagacttccaggctccagaatgtgagagaataaatgtccgttgtgtgaagccagccagcccaagaacacgaatacacctcctgtgtacctgtacccagtttcgaaacagagtacaggtcctggagcaggaggaacctatggtacactgggggtatgctgtgtgagccacactgaagggacaccttctccccgctccctgggcctgtctccctagtagccacctagtcattctgaggactttaggctcacttttgtgacaaagcgctttcctgatcccctttcagatgttcctgaaaagatgtctgctcccttctctgtgctcccactggcactgtccaggcagctcttttgcatgccacttcgtttgctttcccctccatctcgccactagagcacaagtcagttgagacgatgcctagacttgatgtgtctgtcccccttgtgctggtctagcgtctagtacctaagaggggcttaacagtaacttgtggatggcttctccttccacctttgtagggactggcgttagctgttattggccaaagggggtttggaagtggtcagaagggtgatgttgagggtatctcctgggccccagggtttgcagttcccttaatgcctattctaagcaagagatgaagactcttgtctgcatctttctcaggccaccaacagtggtgtttatctgttcctagccctatgcacagagtcactcattcatcacatgcaacccaatagggtatcttgggaagctattgtcctctctaaagattttaaaaataagtgaggcctcttaaaagtctccatgaaccaggtatgaattggggatggaactgaggtgtgcatctgatgctgggtgcctagcattttaagtgttttatcccagataatcctcaaaacaaccagaaggccctcagaacaaagaggtggctggggctcagagaagtggaataacatgcctaagggggaggaagctagtgcaggggagaaccaggatcccgtggccgggcatggtggctcacgcctgtaaccccagcacgttgggaggctgaggcaggtgggtcatttgaggtcaggagttcgagatcagcttggccaacatggtgagaccccgtctctactaaaaatacaaaaattagccaggcatgttggtgtgcgcctgtagtcccagctactcgggaggctgaggcaggagaatcacttgaacctgggaggcggaggctgtagtgagctaagatcgtgccacggcactccagcctgggcaacagagtgagactccgtctcaaaaaaaaaaaaaaaaaaaattctgactgcaaatccagaccccgtctctgactcccaggacacagttcatctggcttgccaaaagcagttaccttcataagaagccttgaatcccagggaactgccactgccatcagtctggaagaggagccacatttgatgattggtgctgacaatgagatccgggaccgatgtacctgtcaggctggcaggagagagatatttagaggtgtgctctccaccatgacacccgaatagaatgattgcctgaccgatgacatttaaaggactatccaggatccaggcccgctcgggcaaattctgggccccactgtgtttctgactctggagcccagcagcatgctctccctgtgctgggaagactcatcctgtcttccccttggctgtgggtagaatctcatgggttgaatcacaactttgactctctagccctgacccttgggctcacaagggagatctgtgtccttacttgctcaggggacagggatagttggagccaaatccaatcaagagggtgtctacattcttgcaacttttgatctcttgtgtgacctgtattgcagaaaagaccaccgccacccccacctccttgctgtctttatgtgggtttcccctcacagaaacccatttctccagttggaacccaagccattctttcaatgagacatctccttccattccaggataaggaacaaggcttagagtgtagtcattatctgagggccacattcttattgaagaagagggtttaagcatgggtgtgggggcggggagggggggattcaattcacaatcccaaccccaagcacctacccatgtaagatactgcacttatcaatttcctacccattatctcatttaatggccctgttgccaggaaggtaggggttgtcagcccatagtacaatgagaatatggaagtgcagaatgggcagtggcttctccaaggtcaacctgatacagtggcagagccaggggtcccctgtgcaggctgggatttccagaagaaatccaacctcattcttttgttgagatcagacaaattaccagcacagatggaggcagggggttgtggagtgggcaactgaactaatgagtcctaatctctgcttcacccagggtctcagagcttgggaggctgttgagtcagctgcagagaggtcatcacaccatgggggatatggaagtggagctcggatagagcacatgggatccaacagcctggcctgtgtgacatccctgagcctgggctctgacaagctgagtaaggattgtggccaggccagtgctggctcctgactctggggtgctgatgagcaagggaaaaggctgggacccctgcttttcctctgtttgacccaattacagcaccaggctctgagtccaccattcatttgctgtgggaccttgggcaagtggttgagcctctctgggctttttcactctatgttaaatgaggggattgtatggtatgatcctcaatagccttttcaaaagttctgctattctaaggttctctctatgtcaaagcacattgggattgtgggaggaaagagagctgggatcctagtctcttgggcacaaagagctgaggcaccatatgggtcagtaaactagggcagaaaatgagtgatggggatgcaccaagtgagggggagaggtaagtgtgatggtgaattttatgtgtcaacttgactaggccacagggtacccagctacttggtcaaacattattctgggtgtttctgtgagagtgtgtttgaatgagatgaacactgaaatcgacagactgagtaaagcagattgccctctccaaggtgggtggacctcatccaatcagttgaagggccaaacagaacaaaaagatggaccctcccctgaataagagaattcctcctgtccaattggctttaaactgagacatcagctcacttctggcttttgaacttgaactgtaacatcagctcttcctggatcttgaacctactggcatttggactgcaactccattattgactatcctgggtttctagcttcttaactcacctggaagatcttgggacctgtcagtctcccaaaatcacatgagacaattctttacaacaaattatctatctatttgctgtttgtctgtctatctatctatctatctatctatctatctatctatctatcatctatctgtctatcatctatcaatcatctatcatctatttatcatctatctgtgtatcatctatcatctatcaatcaatcgtctatcatctctctaatatctatctatctatctatctatctatctatctatctatctatcatctatctatctatctctatctcctattgttctgtttctctggagaaccctcactaatacagtgaattaggcatgggggagaatgccctgtgggctcacattccattcctttgtctggagaaatcccaagtcccagccatgtcacctgattcagtgggtaccattggataagatgagtcatgtaactgcctgtatagcatcatctccaggtaggtgtagggaagttgtgaaaaacacccagaaaagaacagcctcaggacaagccagctgttactaaatggccatttttcattcagcattagaaccagaaggagatatcctggagctagccttgttgggaaggagtgtggcatgggacattgtccttggctgaaatcaaaagacatgaacttgagtgctggttctgctatcaaccttctctgaaacctttgggcctcagtctccccatctgttaaaagagaataataacaccagggcttaagcgagataattgatgcaaaagtttccatcccagtgcctgggagcatggtaggtgtttaatgttggtgacactccacctccttcctggaagggagatggatgtggtcagggtgtttgtctctgaagctaagccacatgtcctgagcagaagcatttcctgactttttttttctttttttagacaggatctcactctgtcacccaggctagagtgtagtggcatgctctcagctcactgcagcctcaacctcccaggctcaagctatcctcctgcctcagcctcctgagtagctgggactatacaggcgtgcaccaccacatccagctaatttttgaattttttgtagagatgggttttcaacatgttgcccaggctggttttgacctcctgagctcaagcaatccgtctgccttggcctgccaaagtgctgggattacatcaatacaccaccacgcttggcctttttcctggttttcaagtcaggctattggtggtgggcaaaagagaagctaaatggtccccaagagcacagactcaacatagcagaatcccatgacagcttgatattctcctctcccttgtctggaacatgtcatactggtcttttttggctcaggaagtgtggccactatgtctatatggtcctgattctctgaaaccatccatttcccagggagctctgagcatgcagaaaggttagcaactcatttccattatctctgtctgaggtcaggctgccacggctggatgtggcctggagtaaaaactgtcagggtggcagaatcaaggtctgcatggaagcagccagccagtggaaggctccaggttcatccacaaaacctcgatctcccctgccccctaacagactgctcattctattcacatttcatatgaattcagtgagaaggtgcccagtgctcttttccccttggtcagagtagagagaggtagaaggattattgctgaaactaggaacattgcaggatactgtctttgctgtagtatggtctagggaccaggcaggactccacaaaccccaccccaccaaccccagccaccgtcccaccttccaaacaacatgccccactgcacttacatgtagagaactgtcttctggtccccatcctgaccaccatcaccgaccgtcagggtgtcatagcccctctccaaatcaaactcctcaaaggcgagcttgatcacctagggagggaacacagggttaggagcaggcaggggctgtgaggaagccttccaaagccttgaggggaggaaggattttctgtgttatgtcccaatgctcagagtcactggtgacaccatcctaaacaaactgaccatttctgtcccactttaatgagtgtgaactatttctctccaggccatgcagtctccagggccccctgatgtttctgaagatgttcatagcacatctggccaattctggtggctgtcacagcaaccgggcacatctggccaacagcgagatgattagactctttcttcacgccttaatgcacagaaatccccatgggcttgttggcaacttttcaggccacatgtggaatctcagctctcttgcccccagggacctgcagaagtttctctcgtcttctcctctgactgcttttctccatcctttttgtttatttgttgaataaatgaatgttctcagaaagagatttcaacaagattcccccctcttgttttaatcctgccttccacaaatatttactaagcactccccatatgccaggctgggcggtgggtttccacagtgagcatgacatggtatctgccctcgctaagaaggggagatagaaatgcaaactgataaccacagcactggggtgggatggatgctacagggggctgtgggagcgaagaggagcctatggctcacccagctggagtcaggggcaggtgctactggagatgggggtgtctgaggaaattctgaaggctactgatgaccccatcaggccaaagggggatgcttggagagggagggagggggatgctctgggaaggagtcaggtgcacagggcctgagctatggcagagatggaacattccagaagaaattattcagtgtctgttgctagcagatctacaaactgaacatacctgctagctgcctggctctcggggataatgtgactgggccttcagtgcaagaaggtgacttgggaaggtctggaatttgaaaagttttcctggagtttggttcaaaaggtctcatacctctaccctccaaaattagaatttatgccaggggaggagcagtagagttttaaatagtgggtgacagggacgcataggtgtttgagaaaatgtcagtgtggcagtatgtgtggaactcattggcaggagtgaggatggttgcaggcttttttggtagtgcaggtgaacgatggaagagtagcagtgtggacggagaagagggagggtcctagtgatatttagggctttgagacaggatgcatgtggtgctgaggggagggaaagatccaggataagttgcaggtttctggcttgtgcaattgtttgggtgggggatggtgccattcataaggacaggacacacacaggcactcactcctgatgtctaatctgtatctctttttgtctgtttcagtctggtttcaatctgatgatgatcctcattcccccaacagggagactgaagttgctcctttgctttctgttctacaactcaaggagtatataatttctgtggatattttttcctagttgtggctgacgccttctgcaggtttcctccatccaaatcaaaccgttcagcacccacatcctgccagggaccctgcagagccttaccccaaggtgctttctcaggtatcccagaggcaaactgacactgccctcattcataagcctgggtagtgtctatgcagggcccctctgcagtggcctgagagtcacagaaagatgcatctctggataatagtatctgtgagcacgtcagtgggtctacagatagacacagaagaggaaggaagtgattgcttttgactgggagaaaggttaaaggaggcttcttggaggaaaggaaactcaggctgagtttggaagatgaactggagttcaaccaatggatatggaagggaaagcaacccaggcagagggaaaggcagcggtgtggaacaggatgacttatccagagaggtctaactactgagtagttgtttaagcaaggaggtggtggagggtggcgataggagagaaataggagcagtcagattatgagaggctgccggtaatgctaagaattttgggctttgtcctaaagtcaacggggagttatggaagggttggcagtaaaggcatgacatgagatttttgttctaggagcaggagcattgagggagagttgaaagctcggagtccaattcgcagcaaggtctaggtgaggtgggatgtgagcctgtagcaagttctagatgaggcagggtgtggacctgtagcaaggtctaggtgaagtgggttgtgggcccgtagcaagatctaggtgaggtaggatgtgggcctgtagcaaggtctaggtgaggtgggatgtgggcctgtagcaaggtctaggtgaggtaggatgtgagcctgtagcaaggtctaggtgaggcgggatgtggacctgtagcaaggtctagatgaagtgggatgtgggcctgtagcaatgtctaggtgaggcagggtatggacctatagcaaggtctaggtgaggcgggatgtggacctgtagcaaggtcaaggtgaggcgggatgtaagcctgtagcaaggtctaggtgaggtgggatgtggacctgtagcaaggtctaggtgaagtaggatgtgggcctgcagcaacgtctaggtgaggcggggtgtgagcctgtagcaatcagtgtttggagcgagttattaaagaggagatgggatttgtcaatagtgagtggggattccttggcccttctgggtttcctatccagaatgttccctgttggctaatggcatcatcatgggatcatttcctcaggctgggatctcccacccatctctcacactccacactcctgctttacagaacatttcctggagtctcatttcctagcatgaaacataagaagggcatctctgcacctgctccctgctgactgccctccactgcacagcctgtgtggccacttgaagtcctgggcattcacaccagggcagcctattcatgaccctgacttacgcaggctcttcctgctccctgtcactgccctagaatatttcttctcatctgtgagcctgacttgtctcagttctctctgactaaccttgacaaggggagcagcccctgctcagccccttcctctcgtctgttttagcacttacctgctggactgtgatgggtctgtttacttattcctccactacaccatgaactcctggagggcaggggtcaggcctcactgcctctgtaccagttcctgtcggtgggccaggcccatgccaggggctgaaaaaatgtagactgggagaacaatttccaaagctttcctgcttctctagcatggatggattgctaggctctcagacccctcacagtggttaccatctagaacaaaagttggcaaactttttctgtaaagggacagatggtaaatatttccccctttgtgtgtcatgtgatctgtatcacagatattcagctctattgatgtagcatgaacatagccatacacaatgtgtacatgaatgggtgtggctgtgttccaacaaaactttatttacaaaacaagcaaagagctgtatttggcctgtaggctatagtttgctgatccctggtctaggagattcttcaagacaatcatagtctttgatcatcttctcttatgcgatttcatcactccaagagctgagacctacaatgtgctcaattctgttctgaacactttacacatatcaactcatgagaaatgcagcactgttgtgggaagtcagggacactgaatggagggaccagctggagctgtggcagaggagcataaattgtgaagatttcattttaatatggacatatatcagttcccaaataatacttttataatttcttacgcctgtctttacttcaatctctgaatgtaaattgtgaagatttcattttaatatggacatttatcagttcccaaaattaatacttttataatttcttatgcctgtctttactttaatctcttaatcctgttatctttgtaagctgagagtatacatcacctcaggaccactattgtgttaactgtacaaactgattgtaaaacgtgtgtttgaacaatatgaaatcagtgcaccttgagaaagaaaagaataacagcaattttcatggaacaagggaagacaaccataaggtctgactgcctgcagggttgggcagaatagagccatatttttcttgttgcagagaacctataaatggatgtgcaagtagggaagatattgctaaattcttttcctaacaaggaatattaataattaagaccctgggaaaggaatgcattcctggggggaggtctataaatggccgctctgggagtgtctgtcttatgtggttgagacaaggactgaaataagccctggtctcctgcagtaccctcaggcttattagggtggcgaaaaaaacccaccctggtaaatctgaggtcagaccggttctctgctctcgaaccctgttttctgttgtttaagatgtttatcaagacaatacctgcacagctgaacatagacccttatcagtagttctgaatttgtccttgtcctgtttcctcagaagcatgtgatctttgttctcctttttgccctttgaagcatgtgatcttgtgacctactccctgttcttgcaccccctccccttttgaaatccttaataaaacttgctggctttaaggttcaggtggacagcacggtcctactgttatgtgatgtcatccctggaggcccagctgtaaaattcctctctttgtactctttctctttatttctcagccagctgacacttatggaaaatagaaagaatcgatgtctaaatattaggggcaggttcccccaatacagcacaatagctattttgagtacctccatttcacaaatgggacaggctaggcacagaatttaggcaacttgcctggggtcacacaggcaagtggtagagctgggactcccaccaggcaggcagtcagaggccaggctctttgtcactctgctctactgcctcatgatgttccaacaaggtcacaggcccacaaggtaggaagcatgacttaagcctctgttttctctcacactttccttgagttcttttttctgggtcccagcagggggtcaggaaacagctgctgcatataaaacaccacaaggcaggtagtgtcttctgctggaggaagggcctgggctctgcagggactgaggggcccggctgcatattctcaccatatcagccccttccagccagccctggggcagaggacacggctcacccagccacctccaaaaagggagtgtatgattattacgcctataatgggaaaatattgctttgaaggccagaacccagagctataaaatgattcacatcactggttagagctgccattgatgtgaaccacatttcagagtgccgaccctgatgcaggagctaattacacaagaagactgttcaacatacacaatgctgcagtttcaggacgagcctctagtgcacaatgtactagcactctctttttttcgtttctttttttccttctctgctttggcctttgtttaaagacaggctcctataatgactcattaactaacatgcagatcaatcaagctcacaaagcgcctttcggaggcaggagaaatggcagcacatgaaataggcatgatcaaagaggcacatttgtatacagctcagacacccaatttaaacccattagataaatgaataaacaaacccatcatctaggacataattactgagcacctgccatgtgccaagcccagagctagctgcttcccataagttatcttgcttgcctgacaatttagagtagaatctaaatgcccaggacatggtgctgatggtgagtgctggaggagtgcaaagaggagagagatggaagggggtccatagaggaggtgggtctgggcctggcgggatggagaagggtgtgtgtgggctcagcccaggctacactgtgagaagtgaagggccaaggagagtgggacaggaagaagagcctggctgagtctgcaggggattttacccacagccagagcaggcagtctggacttcatggtcaagtcgatgggaagctataattcagtgtgaagggaggattggaggcagagagaccagtggaggctgatgcagggtccaagagcatgaggagaaattagggggtgtcacagccaccttgtcctgagaatcatgggagatggagtgggaccctggaggacacccactggaggccctggagaacattctccccttgccacgtgctgtccaggattagccaaaagacaggactccaggtgctgccagcatgtgcccaaagcctgcacaagcctgcagaggatctgccagctcagggcagtcttgtgggaagctagagtcccgggagatgtagactgaggctgttttgtttaaggactgctttgctacaacactttcctaactgggctgtctgtctctgcagcccatccttcactctgtaccaaatgctcttagcacctccctatctcctacagcaggggttggaaaactagctctcagaccaaatctgtcctatagcctatttttatatgtggacctgtggactttggagttaagaatgattttttacactttcaatgagtgaaaaaacaaaacctacaacatagaagaatatgcaacagagaccttacatggactttaaagcctaaaatatttatggtctagctctttacagaagaagtttgctgatggcttccctagagcaatggttttcaaactgggctcccaggtaccccagggttccataaaggtactccagggccaacccacaagggtggaagaggagccagaggagggaagcctctgcttaaaccaaaacagctccattttgatctagttcataatttgggatgctgtgaacaccatggatagtgggttacttaatgtcccttcctccatttatttctccctaacagaaccccaactttattgggagtgtggcaatgtatgtatcttgccaatctcagagctaaagatgtctatgtgacagagctctgggcaaggaaacatgggttgaggagtcctcagaccatttcctcatctttctccttgcttttcctggaatacagatgtgaggacagagagggagcaaccttcttgtgatcatgaggatgagagtcatatgaaaagcagcagagggaaaaatacaaggagcatgagacccggagggaaccaccaagccagccctggactttctgcctctggacttttggtatgtggagaaaataaacggtgtgttttttaagcttctgcagaggaattttctgcacctcccagtcaattacgacctaatggctacaggttctgaagacaggtgtttgtcaccgcagaagagtttgccaactcttgaaactgcaggatagagttcagcatcttggcttggaaagtgtgggctttgcaaggcctgcccctgccacttcctggctaggtagaggccctgccacaatgctgtgctccagccttacctcccatatttctcctcagagcatttctttgagcccctgagggctgaccttggcccacccagcctcagtttacaatgttgctgccagtgtaactattagctccatgaaaggaagggaactcacttttcctgggcacagcttgaaccatgattccctccagggtcttgctgaggccctagggaagagctagagaattaactcctggggtgaggaggaggggaggccagtaggaaggctgaagacctgaactcccaggagttcaaggacagaggcctccagcaggtactaagaagggtcagaggttctggaactttggtcactacctgaggtttcattttggtggttctgagagcagtaagcccttggactcattcacttatggattgactgattcatttattcactgattcattcaacagttacacacctgccaagtgccgggctttggaggggcattggcaggcaagataacatggctgctgccaatagagacctctaagtttctagaaagcttcacagaagaccctgagtacatagactacaatacagtgggatgagggctcaaaccagggaagcatggatgggagacaggaggggcacaaaatcctggctagcaagcgggcagggtttgtcttcagcaacagagaaggtgtgtggggataccacatggccacagccagatctgggcgaggggaaatgccagcacatgatttcgagacagctgtaaaagggaaaggaatgaggctttggacttgaggaggctattaaagggtcccccagatgtgaggaggggctgtggaggcacacggcaaacctctgatcgcaggtgtcttgcacagggcctggcacagagagggtgtttgagtaaatgtttgctgaatgaataagtgagtgaacaaatgggccaacgagtatgtccctgacatttgcactagctgccgatcacctgcctggagaattaattctcagttcttcaggtctacaaaggaaacagtgacagtgataatccccaaggagtgaataatcaaaacgctgttatctttgctttgaagttcatataacgagctttcctttccctcttccttccatgccccctccctctccctcccatcctcactctccatctctcttctgtctcgcttttcattcttttctagcaaaggtggattaactatcctgatcaaatcaagtgaggctcatgtgcaaattggatcaaatgttttgtgttcatactgagaagctgcaaaagaaagacagatgtgtgtaggtagggggcatcaaggcaggtctgggtttcagtcctgtctacatctttgtttttccatgaggctgagctgaagggacctaacaagaggaggccctggaggaagaaggcctgaatctcaagcctctgggatgggcagaaccatcccagaggagctcctcctccaacagtcactcacatgttcaaatatcgctgagctgcttctctatgcccagcactgtgctaactgtggaagaaataaacaaagtgctattcctgctttcaggatgctcacgagctatgggggaaatagattctaaatgcaagaaaacaaaaagtgctgtaggaacaggaaggagcaacacatgatgaagttaggaaggcttctcagaagaggggttgtttggactgtctctcaaagggggataggaatttgcctggaggagaagggaaggcacactgggaccagatgtgcccagacaggtcttaaagggccaggtgtgtctgtgaacctgagttcagtgtggctgaagctggggctgcccaaagggagagatggggcagagagaccactgtgtgctttgctggaagaaggaattgcattgttgacagaagtttagctggtcagaaccaccagggtcgtctttaaaaataagttctggtacctaccctagacccactgaatcagatctttggggaaaagagcttgggaatctgtggttttaaagtgtctccaaggcatttctgatgaaatttgggaaaaattattgtaggcagatgttaatgtcagattaatattataaggactgagataacccaaatgcccaaggtgaggtcaacattgcccgaggacatcccagtcgaagggagggcatggaggctgcatgtggagtaggcctgcatcacttgctctgagccttctttcctctgttccttgaatctatgaagtttccaggaggatgcactggggtgtttttatttcccttactcctagtttattgagtacagacatatccttaacttgcctctccaataagactgtaagttcttcctgttcccacagtgcagaggcgcacagcccatagatgctcagttaatgctggtgtcttgatgtaggttcttagccattcccacaccacagcatccctgcttctctctttgggccttctcattgcccttggagggccccagtccctgggacattcctagctccttgccaagcccaggtagcagaggtcctacaagggagatggaattacaggaaggatcctcctgcgtaggtgtcagggatgcatcataatcattccatgactatgaggagagcaaggggacacatgtccctcttacactcccacaagcaaacctttcagctccttctaacaacagcatctttctccccctgctcctcgcaaagggagccctgcattctcaatcccgtggccctctcactccagaatctcccttctgtcaccatccctcttctcctgtaccttcactctctccctctgtgcatattttttcctaagcctactaacatactccagttccaatattttaaacacatgccccaaagtaaccccaaactttctctctatcttatgttccttgccggctactgcccatcctggcctccacagcctcacctcccatccatttgcttcccaccctactgctgtctgttgctgcccctagagcttcactgcaaagtcttcttccaaggccaaagccaatggtctccttctagcacttttccagcaagacatttgtcatcgttgccatgatcagacatgccctagttggaaactcttcctgtgtttgcatcacgattctcctcccgcctctcagattgctccttctctgttctttcactggattttgctctttctcctgtcacgacggtattctcagatccattctgaattttcttattctcttcagtctttccaagaaatgttgtccattccttaagcttctattctcacccacgtgctgagataacacccaaacctctctcttaaactcagatttacccagagtttccatccagtatatccaaatgacattgaatgaaccacagacattccaaatgcactgtttctctcctgacccctgcaaagcatgttcctccatctgtatttcctttttaactctaccactggaccaagccagaaagcactaagtcatcattcatctgttcatggaataaatataggccgagtacctactatgtgcctggaaccacgttggtcacttgggatacaatattgaataagacctctcttcctccctcagctcccacatccaatcagctaccaagtcccactctatctcctaaatctctctcatctgttttcccctccacatttccaaagccttggtggatgtccccatttttcctacttaggtaactgcttcatcctcctaactggtctttctccttccagtatccacctctaaacttctccattgctgctagagtaattttccaaaaactcagatcttcctgctattgctttagttcaggagatagagtgatcctcgtccttccaggctcatcccactgaggtgaagcccagcccctttcatctactctgagatcttgttccatccagcagcacagcccagctatgtaagtgcatgggctttggagctagaaagacggggtttaaatcccagttctgccacttactggctctgtgcttcagctgtttcctaacctttaacctttccatgattcagtttctttatctaccaaataggtatattaaaataaaattcattgtcctattacgagaatgaaataaaatcattcatatagacagcttagcttagagcttgtaatgggacaggcatacaataagagctattattgttgttaacaacagcctaacactgctagccttagcaatctgtgttttgagataaaacccaaacttctgggccaagcatgtgggctcaccatgatctgaatcctgcttacctttctgtccttacctgcatccaggcatgttgaattacttccagttctaaggggctattccaaacctcagtgcctttgcacatttgtcctccctgagatactgatttccaagcctactcatccttcaggaccctgttgacatgtcacttcctttgtgaaaacttcccttatctcccagttagcagctcttccctgagttttcccatagcgctctggacatgcctccatcaggacttacctgcactctttttttttttttcagacctgttcttcactcttacgtgcacactcctcaagggcagaggccatatctacatcaatgaatgaatgaatgctcatctcataaaacatactgtgagcttagagactatgctttttgctgaaggagatgtctgaaggtgagtggataggcagtccttggatacacctgtatctcacctgtaggccagttccatgaacagggttaggcacacagcatccattgtccttgctgtttcccagaagacaacttctattcctcagtcttagactttgagtttccacacttagaccctccttgttgcattgtatgttccctgggtctcctcccgcctggatcaggatagggttctcttcagcctttctgggctccctcagcactacctgaagcccaccaaggccccacagagatattagaaacactgctctgcacactctaagcggtgctctgcagaggtgctatctttagaaactcaggctggtgggatctcttgcaaggcatgtaggggagtgaccatatggaggtcactggtctccacacactgaccaaggctaggccttctgggggtgaatctaattgtttcttagaaaatcctcagactttacttagacttcccccgacacctcaccttcaggttcaaaagaaaatggagataaggattgtaacagtgcccaaggaagagccctctagtcaacaacttaatatgatttcatggtattaagtccttctggcctagcctccaccctcaccccatgtggctgaagtgtcctttcccattaactaggtacatcatgaaataatttaattaaatgtgaatctttctttgtaaaatgttgtgcagaggaaatctgcttccagtgttcccagcactgtggttccaggcacccggaccaaacaattttaaagtgttaggtaaaattttaaaatgacaaaataaaaataaaaataaaaaaagcagctttttccaagttagtgttaaggattgaattataatatgtccccctgaattcacatgttgaatccccaatgtgaatatatttgaagatggggcttttagggaagtaattaaggttaaataaggtcatagggatggggctgtaatccgatggtagtggtgtccttatgggaaggggaggaggcatcaaagagcactctcttcgtgtgtgcacagaggaaaagccatgagaggacacagtgagaaggtggccatttacgagccaggatgagagccctcatcagaaaccgaatttagttgcactttgatcatggacttctagcctccagaatggtgagaaaataaatgtctgttgtctaagctatctagtgggcagtattttgttacagtagcctgagtagactacattagtgtaataaggaatactcaacacagtgaatggaggaatctaaaatgtgattcagaacatgaagacggctttggtcttgagtaccttttaaaaattcggtcaatatagcttcacttttcagcaactcatagaaaagagggaacaggagacaaaattcagggcccagcacaatggtgactgtaatacgatacttctgaaagagttgggttagttaaatctgcacccatagtgtgaaggtgaattagaaatgagcctatctccttctcacctgtcactaccaccctctgggaggatctggaggctgactgtttatcttagaccttgacactgagtagacaagaaaaatgtttccactgagaattcacaacagtaagtcagttttcacatgggtttgcagccttcatattacttgggtggtttgaaacctccatactgagaattttgtgtgaagaggtttctggctggtaatgcccccagcactaggcagaagcagatgcaaaccctctctggaagaacccaccatccacccaggtctcaaagaattaccagagagaaaatttacccttctaaccacataatcaaacaatataaaacaaagaaggaaacatggttctgagtgcaagaggtgagaaaaaacagaatcaaatttgcaaaaacttcagatattgacactaacagacacaaaatataaaataagtatgtttaattatggaaagaattcaagaatgatctaaacataagagtatggagcaagagtttataaaatatgacaatatgactaagaacgtttgaaaaagaatcaaatagggcttcataaagtgcagactacatttgaaattaaaataaatcttcagtgaatggatttaacagaggctggacacagctgaacagagaattagtgaacagaatgaaagagagaaagtatgagagaggttaagaaatactgatgatggagtgagaaagatgaacatatcttgtcagtcttctagaagaagaaaaaagaagcatttgaaaagataatgggtaaacattttcccaagctgatgaaagatacaatccatagattcaagaaacttaattaaacaggatgaatacaaaaaatattcacacctagacacataagggtgaaactacataacattaaagaacaagaaaagacagtaagagcagccagaaggatgctatacaaagcaatgacaataaactgacagcaacagtgaaacccagaagacaccagaacaatatttccatgtgcagagagaatggaactatcaactgataatcaaatgtccagtgaatactagcgttctttcaagaacaagggtaagcagacattttaagacaaagaaaaaattacacattaggttctatgcttacagactgggtgacaggatccgtaccccaacctcagcatcatgcaatatacccatgtaacaaacctgcacatgtacccccgaatctaaaataaaaattgaaattattttttaaaaagacaaacaagaactaatagagtttatcattgacaagaaaataaattttaaagcatgtatttgcactgaaagatattccaaagagaaggactgatatacaagaaggagtggtaaacaaataagtggtcaatatatgagtaaacctaagtggacagtggctttatcaaacaataacaataataacttgagaaaaaattaaggtaacataatatacacacaccatagagtatgaattggaaggaatgattaaagtcatagtgtcctaagatccttggcttttcaggaagaacacaaaattattgtttaatgctaggctttattaagtaggcatattgctatttctagagtattttaggacaaatttcaaagaatagaaatgattgtataattcacaaggtctaaattctttagttaaaagacaaatggtcagaggggatttttgaaaatccagctatacacaaaacacatataaagcacaaggaagtcgaaaagttaacagtaagagaatagaaaatatttattagacaaagaccaagagaaaactgatgcaatggatggagggaaaaagcctttaaggttaaaaacattactacagataaagagagttactacataattatttttgaaacagttcaatttaccaggaagatatataattctgagttttaactttgatgctctaataacacagtctcaaaatacatgaagcaaaaattgacagaactttaaagaataataggcaaatccaccatcataatggaagattttaatattcctccctctgccgttgattgatgaagaagacaagaaaaatcaatgaagatataaaagagacaaacacaattaacaagcttgatgtaatggacatattagaaaacaaaaactgcaaaatgcagggtttttttcaagcctacacagaatctatgtgaaaaatgaccatttctggtcctaaaagcacaaatttcaaatgattcaaatacagatcaatgttccctgaccacaagatttagaaacagtaggaaagagagagttacaaaaatcctttgaaaattaaaaaatacttctaaatagctcatgcttaaaagatgaaacaataatgtaaattaaaaaatattcagaactaaactataacagaaaataaataactgtaaaaatctgtaggaatgtagccaaagtagtcctcagagggaaatttgtagcctttgatgcttaaatcagattgaaaaataatgaacaaagcatcaaaattaagatgctagaaaaagaacaacagaataaactcaagtgcattagaaggaagaaagtaataaagatgagagcagaaactgacaaattagcaaataaatatattaaaaggaatagtaagaaaacaaaaattcattttctggaaagactaacaaatgttaaaccactgccaataccaattaaaaaatgatacatattagaaatgaaaaagggaattgaaacacaacaatggcaggtatcataactataataagagatagtatgtataactttatatccaataaattttaatatttactaaaatggagtcaagaaaaaaaaaacagatgaccaaaataattctctagccattacatgtattaagtctatagtctaaaatcttcaaacaaaggagacaccagaccacgatagttttgctgaaaaattctaccaaactttcaaggcaaaagttatgccaatcttccactaataaccccaaaggatagaaagagaggaaatactcttcaaatcattttctgaggctagcaatatattgacacaaaaattggcaaaggcaatatgaaaaaacaaataacaggccaagctcactaacaaaatagaaacaaattactaaacaatatataggcatgtataaaaatgacaatactaaatgatcaagttatgttaatcttaagaatgcaaggttggtttgacatgagaaaaggcaatatttgctatactaagagaataaaggagaaaaattatatgattgtatcaatagatataggaagatgcttcataaaattcaataaccattcttgataaaagctcttagcaaactacgattaggaagtaaattccctaattctattataaaaggagtatctacaaatgaaaaataagcttcagcaaacatcatacttgatgatgtttgatggtgaagaaataaaaacattctattaaatatcaaacaacgaccataggggtcaccatcataataatgatttgatgttatactgggaggttccaaccagaactctgaggcaagaaaataaaaaagaaaaggtataagaaatggaaagtagaaacaacaccatcatttttttgcagatgatgactatccatgtagaaaagcccaaagaattcagatacatttttacaagatagttgctaatataaaaatcaaagtacaaaatcaattgcatttctaaacaccagcaagaaacaagtagaatgtgcaattttaaaagatttgatttataatagcaacgataaatataagatatttaggagtaaatatattaagaaatacataagatctgtaatggaaaaaattatacaagtttattgcaagccattaaagaaaccctaaacaaatagagagatataccatactcatgaactggaagactcagtatcaaaaagatatcagttcttctccaattaatctgtagttttgataaaattaaaataaagattccaacaggttattttgtggatcttggcaacatacttgtaaaatttataagagagaacaaagggcacaggagaaaaaaactcaacaggaaataaacatgaaaaaatgtatgtagaagtacaaactacatacaataacttagataaatcttaggaacacaattttgagtgaggttgattaagaatacatacatgattacatttatatgaagttcaaacgttagcatactaagcaatgtatttttagggatacacacttaagtgctaagtataaagaaaaacaaaggaataataaacacacaattgaggtaatggttacctctgagggtgtagggaatgaaacaggattggtgaggaacctgcatcactaaggtaacgattttcttttccccttaagctgaacgatggctgcacaggtgtttgttgtattggtgttctttatattttgcttatattttataatctgctttttatccactcgatattaataaaaaaaaaagtaaaagaactgtctgcagagaatctaccatcagtaagttctgggtttgaaaaaccttgtaggccaactgtccccaacctagccctgcccacagaacaccaccccgctccccaagaggcttaccttggaggggttgagtgctgtgatgatccacacacagtgtgcattgttgtcatactgaatggggaaattgggggaggtgatgatgcccgaggggcctcgaaggtgggcatcacacatgcgggctgcagaggagatgaaagacaagcctttgaattaagactaggtccagttccccttcttgcctcccactccccacccagaagacactgcatctgtacagttcccaccctggacataaccttctgcttcctgggtccttcctctacagttcttgggaggcttgaagggaagccgcagtgcctggagcactgtgactgctgttctgtaggcaatgatgaacttctaaggcaggctaagcgacccctctgcatgccccacttacccccacaccccgactccactatgatcatgcaattcctctttgtcaagagggtgtgggctagaacctgtcaggttgacataaagctaggtggatcgcaggcacctatggacacctaagcagcccacgccttactctgctgacctgtctgtttcccaatttgcactccaattctccaaaccagctgagtgctgctgtggacctaatgctgcttaactaggagtctgacctcattccaggttctgcctgcccctcagttccttcctccgtgacccccttggtcctcctgaagaggaatttcaggatatccttgtcaaggccactccattaggtctcagaatgtctatgcccaagagctctgccaaggcccctgactcagctcagtgccaggcccccagagtgatttcactgcttcccaaatccgtctccacactcagcttatccctgaaactggcttttgactggaagcataaagattcaaggtgaattagaagtgttctactcaagtagatataaagtgttatcaatcacagcttaatctaattaagctctttaaaatagcttctaaactaattagattaagtagtgatttataacagttaaggtactacgttgtacctaggtatttgctttctttaaaaatgtgtgcttagttctagccacttcattctttaacgttagtgttcagctattttaataaaaggttctaagagcctgttctcatgctgcccacatggcaatttatcctaattgtaggcaaagtgcctaacagtaaagaaatagtgagcaaactcaacaagcttaactatataaaatgaaagtggtgtcaaacctagtttcctctgatggggccaaatatcctagagctccttgccatgtgtggaaagggccatgataaacctttcccaggacacccttcctaggagggtctgggaagcaggttctgcagctcctagacataatgaatctcttctcatttcatgcactcattcctgcgcttagctcattcattccaacatttattgagtgcctactatgggccaggaaaagtgtggggagaaaaaagtgtctgacatagcccctcctctctgaagggccacagcaagtggagggagcaggtggaaaaacattcaccatcaagcagagcaggtgttgtcagagggttatttgcaaggggcttttgggacaggtctgttacctcctttttgttagctcatcacctcctgggaggagatttcttctcactgtagtcctgcactggaaggatctcctcctccctcatcctgagctcaagaatctgttcaatcaagtttgaacaagtcctgggggaacccccactccattcccccatgtatatctgattgctcctttcattctgtactgagaaacacttagattcctagattgcacttgatacaactgggccctatggcaatgtggcatggttaaagcgaggtcaggttttaaaatttatgaacttagccttctggatctaaatccatttgctggtcgcttaagtctggatgagttagaaaatctgattttgtttcttcatctgtaaaatgggacaaatgataccacctcattgagatatggtgaggatgaaattatatgagatgatggatgtgaaggttcagcccagggcctgggatgtggtcaatattcaacctttgggacaagagataatcagactcccaatgccatgtctattctgtttctctatgcccaggatttctctcaaggctaaggatcctttttctgcctttcctgaagtttctggacataggtttttttcccccacaagtacactcgagactggcaacattactaaacaaattaaaataagacaatcaaagccctgattccgtcccacctttgcaaagaggacctgtggactcagaactctagccctgcagagaatccttacaaagctccaccagcaccatcttacacctcttccggaaagtcagattttgctgcccaaagccctcagcttcagaatcaatttatcttgtacttgtttccaagaattagatggtatatttgcagtctgttgaaacatgctgaaggtaatgagagagaacaggccaaaaaggcagttaccactttaagggcttagaggggtttaattaaaatattacagtctgcagatagcatagagcaccttaaactaggttcaaaatgaagcattagctacttttttcctctgctatctgagcaaagtcaggggttctgtggacagacagacagacatcaccctgagcagccagctccatgggatcccatcaacagatagaaagttcatcacagtgacccagatgggctggcagaatggtaggtgctcaatatctcactaaatgaatgaacatatcattttgtttctctatttgcctttttccctgaaatgctcttctggatcgctttcaggagagacttccctgagatcttccatgcctgagctctgcagctactcccatttttcctctggacattatcatataatgggaacagtatcccaggggaccatagggagctaccacctggacccacagccagttctgacactgaaacaacttggtgccaaagaagagaactgctccgggtgcaagtgcctctggtctcatatcttctctccaaatctgattcccatcctgttccatgctgccttcccttgcttctcctattggcctccctcccaaccctttccacagtcctctggaaccacctcccactaccagttctaaggaaaacaaatcctacttgtagctgcaacatctttcggaacctcctactcccactactgtcctgactgaagcccatcttcccctcctatgccactgcctcctatgcagccctctgtagtcaagatcttgctcccaccctcaagtatttctttcacagttgttttctgaacctccagtagagttcatctttccccactgagacctccactctgttgacagcaatatctcctctctacccatcagctccttcggtcttgtcttctgtccttatgcaaatttgatcacatgggccaccattaggctcattttcttgcttgttccaagtccctttcttcttcctcctttcatcagttgcctagaagacatcagtttggaatgaatctctctacctgccttctccatacctgccaccatacagttgagctttgctgtgaaaaaaatcactagtaggaagatgaatgtctattataaactcctgattactcatctcaaaaaaatcctagctattgcccagtgaccctaccatttatctctattagctcactctctcattctgctcaaagactttttcacatgttctagacattccttgaacatcttcctcttcctcttatctccccttactcttagccgatgactttggctttctctttggagggaacagaagccatatagcaggcgggtcctttgtcccactctctaagaatgcaattctatctgcacgtgtactcaattcctttttccctcctgtttcaatggagagatgtcccttgttttggagggcattgccctcttatgagatctgacaccctgctcttcctccaactcatgatcaaccatgtttatagccacacccagggccttgctatcctgggagccaggaaagtccaactcacagattttaaacccagtcattccattccttcccccactgcctgtgttcccagcagaatgacttgggtctcaatgcaccattgtcctacatcataggcccctctagccttctggctcccacatttcatcccatctattgatcctcgcctgacccctcttccctcactatccagtctggacctcaagaccactcaccaatacctacatcttcctcatcgctctcatatctgcttggtgaaatgcctgctttccatcaattctaccactcaccttttccatctctaatcctgggggctggggggctaccaggagaactgtggtatcacgacagattcatggtttgccatcacaatagaaacttcagcccaagtctatcatttcccatgtcttccttcaccaattccttgcagaaacaagttcaaatattcaacacttggttgagtcactaaccccaatgtttacttttcagttgtgattatacttgacctctctagagtatctgacactactgatctttctctctttgtgaaactcacattctttggcttcagtgacgctttttggcttttctcctacgtttctgaccgaatttcttcttagctttcttcttctccactaactttttaaaagcagttgtttaaatctaggaaagggtacatgggagctttttgcacattaattgcaacttttctgcaagtttaaaatcatatcaaaattaaaagttacccaaaaaaagtggggagtggagggggagttgctctgcatggttccatccaatctattgactccgaaggatgtccaggtacaattttcaagtagaagtaggattcagcctttggagtcagggtttgaaattcaactcaacagatgtagctttgtgcccttgggcaagttggctgcccactctaagcttcagctaaacataaaatatggttattgccactttactcataaagaaattatgaaaaatgcctagtgcaatgctatatacaagtatacataatttaataaataagagctttatcattagcacatataggtaagggactgagggacattctcagggctggagcaatggggcatgtactctagtacaatcagtatgtgtcatccagggaaaataagtggagaggagaagagaggaaagaagagaagagatctgaaaatagaactctggataacaattatgtttaaggagtaaaaccagaaagctgatctaatgaaatccaccaagaagacagccacctgtaattatcatggcatttaattcaccctggtttgtgccatatttctcctgttttactgcccttttacagatgaggaaaaagatccatagtgtttcagtgattttccctgtgccacatggttaataacaaagtcggaactttaacttaggtctctaagtcccaagcttggtattctagccacccaaaggcatatacatatatatgagtttagccacaaaggaaaaataatatatataagttcctgttaattatttactttgtgaatcagtaactgtaagagtttcatctgggcctggtactcagtccctaaactctatcaacaccaatttgtgatcacaagaaatcagagctggttgttaatttggtcctctcactataccagtggtttacagtgttccctggggccccaggggtaccaggactcaaaggctactgaaaatggtgatggaggggagactagaaatcccctgacccaactttaatcagagatgctccacttgtatctgttttatttattagggttctgcaaaaacttatttttgaatattgggctccatatgtaaaataagtctgaaaagctctatatctatggactctgcctgtatctggggctgaacagaattagtttaacagtgtttcacattgccctcaatctcctttgtgtgatgaaaattttctaggagtcaaattagaagcttatttcttctgatgggagggaaagaaaagaaaggcctgtgaacgcctaatttcatatctcaaaatgagggcacagtcccatattgttcattcatttcaatcactgattcattcaggtggtcctcaaacattagctgagaacctattatttgccaggccccatgttttagtagaattaattgtgtgggaaaatgagtatttctaatcaaatcatattttaactgcattaaagaaaaaataataccattattatggtaaaatcctttttagaatgtgatcttttggtaacctgcttgttagtggaacttcttggaatggaaagagttttgttcgttttcattcttaaggtggggttcacctaaactgtcctaaaaatcacagaatagtgattgcgattaattgaaaacaaaatattttaaaataaaaaccttaaaattgccaaaataaaaagacgctttactctaatatctatctcagccctgggccttcagggaagcccaggacatatcatccaagttcaaacccaggagacttagcagtctctctttctccttcacaatggcctataggaggggagaaaaaagagagaagaaggcaggaatattaacctgtgttgagaatgtaccctccaccaccgtcagggctggtcactttctagaaaatgccttgtttaaatttcataatcagtaggcggggaagattttgttttccttgttcacaaatgaaggcctgtggctaaaaaagatgaaggaacccgcccagggccagcaagctaaaaggtgtcagagttgtgatctagatcaaagtccatgtgactcccaaactgtatgattgcaataggattagacaagacagcttctaaaagaacctgcagcaactagaggctgaggtttgctccagggcttgaggaagcttatgtggacagtgcccagcaggttaagctgaatatgtgtgcacgtaagtctcacagacgtactggcatcacttctaaacaaggactgcctcatctagtcctcaaagtaaccccacgaagtaatgttctattatcaccactttttggcaggaaaaaagagattcagagaggtgaagaaactggcccaagggccccagctaaaaatgatgatggttggatttgtaccatgatttcctgttgttttacagtagcaggtgatggaatgagatgaccacgtgaaaaagcccagcccaatgcttagttacaatgcagcagagaactcagacttcagtgggtccaaatcactggagaaaaggatgaacacactttttcagctacaaacttccctcaggtcaaaaccagcccttctccacccttggcatgttcatgtaaacaatcatcatctcttgagaactaagagaacaaccttcctctagtgaaaaggtcttgaggagggaccagatcccaccactgcaaaaggcattgtcatcctggcttctcaaaaggaattctgaaacgacagatgggcagggtcccttggtcctcagacttgataattctatgcctctctgcacagctggtgtctgggctccctggcattggagtggtatgctattcaatgagtcattcattccgtcatccattcaacacctgttactgagtacctgctacatgccacgccccattttaggcagtgaacaaaacagaagtccttgccctatagagctcatgttctactggcatgaggatattttttttcttctagcacttttcaattcataaactgcttacacattcacaactccattcaatctccacattaaacagaagaagggtaggatacatactattagcaacatttggaggtaagaaaggcttagggaaaatgggtgatttgcccaattgctgagagttatgacaagaattcttttttgttgtttgattttttaaaaacatagtagctatgtagaatccttgagataatatagctaaaatcagtgaaaatgcaaagaacattataaactgtagaacatggccacctcaaagttgaatgaggatgtaaggcttatttgaaagatgttatagtgacactcttctagattacttatggactcagttaaaaaacaggatatgggtttcagctccaactctgcccctttctcagtataataatgagatattatttttcctggatcctcttactctgcatgaattttatcttgatgcatatgccaaagagaggcaaagaatctctttcttagatcagaaggatccagcatgtaactttgcagtgggcaacatatcttctcctctaaaggggcactcaaaagagcacctgttggcttttaaagactacctaacagcctagtgcacaggggctctctctgctggttccctgggggatgaggtcaggggcttctctaccacagaagcagctgtagccctgccccaaagcaggaatacacttggctctgttattttaagattatttggggggtaggggctaggccagcccaggcttggctcatgtgacacctggggatgtggtggcagggccctggggaacaaaacacccagatagggggttagaagcatgtcatcactacataggtaaaaacactcttgcagaagtgacaagtctgtctgttgcaatatggggaaagaaacagggttcaagatgcatgtgtgttgtaacagagggattcaaggtgactgtataaaaggtgacttcctttcctatctaggtgtggttcagtatccattcaatgaggtagcaagctgtttcttacgtgcctcacccattagactgtaaggtccatgcagggcaagcaccataatgcttatcttccccatctctgtatctcctgatcctagcgcaggccttgatactgagaaagggctggataagtatgcttattggtaaataagtgcagggagtgaggggggaggggagccagtctgcttgagagcctgggcctcaggtgctgggagctgggcttcagcctccaggctcagcccaactctctggccagcctcccttccccagggcaccctcacctcggcagactggcctgtggtcgctccaggccgcaaacatgtcgctcactttcatacaggtgatccgcttggacccttgcaggtcatagccctcgttgcaggtgaactggacgctggatcctaacctgggagacaaagtgtgtctgtgagctccatccctgggcctgccaagccccgccccaagtccttcctggttccacaaagaagccgcacatgttatttttccttctggcccttaatctctgctccactgttttatcactaaaaatctccattggaaggaacatctgctcttcatcttcttttttcggactgtttaatggttttaggattgagttaaaaggtgactttgtgagcaaaacagcgatcctctgagataagcaccagttagggcagctaagcgtgggtggatgatacccataaactttaaggaaaatggtctcctagattattgcaggcgcgagttgccttctggcgtgtcattactgagatggcagccctttgtaccctgggtacataggttttctggataacactggcagtctacagttctctccccccactaaagcatgggcactatgccaaggactgaaccaggagagaatgtcaaagccatagctcttctccaggaagtgtctgttcctatatccatgccatcctctccatttccacctgcaggaaggccagcccctgtcttcctcccagccaggccaccccacccttcttgcaatcagaaaattcccaaatagatcttacctgaaatccgagcctagtcttttgcccctttcgggtatgccagggtctggacacatattatgtccttgggacacaccaacctgagttactacaaggcaaaaaaaaaaaaaaaaaaaaaaacagcacacacagagatggacagtcacagggaggcaccagctggggcaatgtctcagggtgggaggtggaggcagagacagaatgaggccctgctttgttggggctgtgtggggtggccggagtctactggcctggggtttcttggatgtgcaagataggaggctgcttttgacaaattcctttgtgagcaaagtcatcacgagtgtgtgggctcagagacaggccctccatgccaaccaccacctgcttccctcgtcccacaccagcagccagaagtggaccatccacagcccctggtgacctccccccaccacgcctatgcttcagatctggggtggagactctagatgaaatgagccccccacctcagccccagatggagaaatgactcaaagaaagttaaataaaaggtgggtgcatgatcagaaacggtaaagaatgtaagagaaagctgcagtcaaagttcaaagctgggacttcagctcaaacacagacatttcttctgagaaacctcttcccatcagatacttctcgagccagagtaagcagtcaccagagcatcccctacccagtgccacccatcaagggcaccgggcagagatggcacctgtgatggttctggtaggtggtgcaatgctctgacacttgccagcgccagagtcctatttacaaaaaccatatgcacagttgtcttggctagaggagaagcttggtcagggggcagcggatacacacacagtagggagggtaggcaaccctttggcccctgcctgttccttttcgtcgggatgctggtactgaggaggctggattcctggctttgaggatgaccaggagctggagccaggcacacagcctggtcggaggagttccactcaaagcctcaccaatcccatgaccccaacagcaacctctagacaagggttccagggcatctggacagcattcggcattttccaactttgcgcatgtccctcccatcccattcaatgtcccataaggtgaacaaagcactccattactcactcacccacttgctcacataggtacacaacaagcattcattgagcacctactgtgtacaaggctttatttggataccatggaaatgcgaaaggtagtcagataagaccactgtcctcaaggagtttccagttgagtgaggacataaaccacggaagcggactgtgggaccacagtggggagggatgaaggatgcacccgcatgtgaggctgcctggaagaggtggcatcgaacatggaccttctgagctaataggatttagacacacggcaacagagatgacaaagatagacaggcacgaggagtgaggtggaaacctggaaagagaatgcgtgttatgcagtgtgaccagagtaggagggaaggtgaagagtgacaaggaagagtggatggtgaggtttcagagatcagacttttacggggtttgagtctgatcctgaaaatgatggggagccgctggagagttctggtggggagaaggcgtggtgagacccgctggctcaaaggtgggccagttacctagagatgagttaggaaattttgtgattattcaggctgaggacaacaagagcctggagtgaggctagacatgagacagcaggaatggatgtggcaaagaaagaatccctgggactcacaggggacctagggcatgaggagaaggagcagggcatttccaggatttccagggcctgggtacctgtgaggatgcaggtggtttcatagaagtaaggaaggtggggagctcgttttagactcactgagggagtctacagttagaggcctgaagtagaccgtgtttaaacctccaggtagcccaggctatggctggccatggaacctgaggatttggacagactgtgtgctcaagccagacacaggtatcctcttggttgtgtgcagtgcacgttcaagccagttacccctacccctacttgtctcttacgcccatccccttccttgccaagcctttacctccaaagctttcacatcctgagccgttcccaccagtccagacacctcaggctgggaaagtaagatggaagtgccattcccgaagcagaggaagctcctgcttcctggaagcctcagttttttgcaagtaatggaacggagataactagggggtcctctaaggcacccagaaggtgggaaggaggaggaagcctgagctgtatttgctgccttatctgtggtaagccaggtccccctagagcttcacagtgatccgtccctactgcagacttcccagctaagcacccaccttctttagattctgtctagtcaaccctgtgacccacgagtcatacccatcccaaagtctctgctgaccatttcatgggaaccacacagcccccttgcagcacgtgaagaacatatggcggttccctttccccttctcttgccctctcattcagtattgacatcacccaggaagcagaacgaacagaagtctgccccatcaggacggggctggactcaagaggcgagaccatggcaaagcccacccgccaagccacaagcccctgacagacagagcagaccctaccgcctcccctttcctcagccagccccaggtgaaacccaggcaccatccagaaagtcacaaacccaacggtgacgcggcttatacccagccagtgcccccttccagggaggactgagcaggggatggtggtcccacgaggatcttcaagcttccccaggaaacaagcaaacttaaatctcagcgatcagtttactgtctgaattatggaggcaagaagtgtttctccctttcttttttttttttttaattccagtcttctctgcctactcaaaaccagctgcttgtgtttacagcattgctttcctgttggctactgagggacaggaatggggagtaatccttactctactctgggagggccactatggcaagggagaagccgcaatgtgctcaggaaggcaccaccttctacccaacgcagggagtcacaggtgggtgggtggtcagaactgatggcaaggtagagagttgggtccactctccccatgaacttcagggcagctgtccacagggaatttgggcagaacacaggaggccagccacctgaagacatgtggctacctgggtctgaggcagctggagtcacacacccattctttctgaggaactcttagaatggaggctaatatcttctcaatagagatatatatatttattttgcaaagagcatttgcattctttcattagaacagggtttctctttatcttcctgagggagtttttggcatcttcttagtcggcttaatgaaaaccctgcatcctgtctccagaaaaatgcacccagagcatcacatgtacttttttggctagtccatgggcctcctgaagtcctaggtcaacaagacccatcttagatctggcaacactcttgggaggaaggcagggtaggattttgcatccccattctacagatgtgaaaactgaaacattagtgtctggggtaacatgctccctgaggacacagttgggataaatatttgatctcccaagtcagggccatttccttaagtttgcctgtggctccagggcaaactgtgaaattaaactgtgcctgcctcagttcattgggtctcctgtggctacagaaagaaaaagcctgtgagggtcagggccatggcttgagccctctgcaggttcctggcctgaccctgggctctcctagcaccctgtcctttcccctaaacccccagtcaagcacagaagaaggctcttctggtgccctctgccatccagtccctgagggtggtgactggagatgccagttcctggctgtatccaacagcctgtggcaactgtctccactcagacaacttcaaagaccacagacaatccccaacccaggctcggttcagtcggagcctgagaccaaagtgcctcttctcctgatgttctcccggccacacacatcggcacagagctcgaaaaccaccggtgccactctatgcccttctctcctcaataagtacttctagcatctccaggaaagtgagcacatggaggtgagatggaaggggaggaatggggagggtgggaggagcaagtcagggacaggaagacaagcagggagagaagaggcgggagcagaaggatgagaagaacgatggagcagaaagtggcaagaggagaaaaagtgaagggagagaggaccagagatgcaggagaagggcaaagggagggaaggagaaggaaaaccaggtcagtcatttggaggaccaaggaaggctccctaccactcggcccagaaggaaagtggaaggtttctggaaaaaaacctcccctgcttttaagcccagtcttgtggaggtgcccagaaccttccccagcccttcctgggcttcagctcaaaagccccttagcacaggccctgatcaggtgtttctgggacccacattccagaccattccccagaactagacccctattaaccttacaaacactggtagcaggaacatgttctgaaagatgtcatcctccccatgcccaagaagagagcccccagtgcctccccattgacccgaggcaggacccacccccacacttccccagtcctctctttgctcagccaggtccaggggcccttggaggaggttactaggcattcccctgcctccctttcccaatctggccttgggagctggaactggggccctacagcccccaagatcccagcccaaggttactgactcctaaaagaggagctgaaggaggactgtcttagcaggtggaagtgattcaaaaggaaaataaagagagaaatgtagcagtaatgactccctggactgcagttcaaatgggaagtgagggagaaagaggacaaggaggaaaatgggaagaggaggaggagaaggcaaagggcaggccccagggctgctctctggccgttgggtcagtgtgtccaagcgcagagcccaggatggaggaagcagggttgaaggaaagtcattccagcatcatctggcttccccacggtttagtgcctgcacgtgtgacctcaagcaagaggcccggcaggcgggctggcgggcggacacttacacacagacgtcttctggctgttgtctttgctgggcatcagcttcacacctcgagacttcaactcaatttgcttcttgactagagaggaggtaagaggaaaaacaatgtgagttgttgcctgtgaccagggataagggtccctctagaaggattcccccttgtgccttggaacattccatggtgggtcaaagccaggaacttctgggctgggacattccaagggtagtggtcaagggcaataggacctcagacatgaaggaaaagttactatcaaggctagccctctgagggaggccaaaaatgtggtctcctactgggtgggctctgagaggctctgggactcccccggtggcctctcacagatgtctgagatttcaccagacctactgaattcaacctgctcctcagcaaacttttcatgagcgtcgacgtgtgcagccttgcagcccacctctgcttctccacagctttttctctacctcagttctgagtcagccctgacagggtatggtagatcagaatatgggcccaaattgtcactactcattgtattctcaccatttgcaatgtgattttttagctccctccattacagaggtggagtacattcccccactccttgactttgggtttggccttgtgacttgctttggccatgggaaatttggaggccttgatgtgttcaaaggcataaaagcacttgccagattaggcttggcctcttgcatctctgccatcattgtgagacaacatagctgctcccaggaggataagagacacatgggggaagagggaattagccaagccaagcccagcctacataagccaacctcttacaggcaggggaagctgaatcctggaggtcactgggagatggggcctgactcaagtgggtgcctgatggatcagatctggctttgaccctgtcactaagtccagcctagtcctcagttcatcagaactttgccaaatagcacacaaaaggtgccagagccagaactccataattccaaaggccattcctctgtacccatcagccgcctttggtctgaccacccctgttacccaaggcattctcttggcctctaacagcttcaccctgtctctggttatatgccttggagcagctgtttaatcccagctacccacggtgccatcttccagctggccccgcctgctgacttagccctgctcagattgatacccaggagtggtgacaacaactgtaactgggcacttcatacgtgccaggtccagggtgctttacaagttctttacttaaatcagcgtccttgactcctctttctcaaacccacacacaatccatcagaaaatccttccaaatatatcccaaaggcaaccacttctcacaacttccattgtctatcatcctgattcaagtctgagatacctttcccctcatgactgtggcctcccattctccacccttgtccctatatagtctgtccttagcacaagaaccagagggatcctattaaaacataagtcaaaccatattacatctctgctcaaagctcatcagtggcaacccatgtcttctagagtaaaagtccttaagatggcctgcaagaccaatctgttctccccatgacctctctgactctgtatttggcctcgattgctcttctccagcctcatgggcctctctgatgtgcctacaatatgccaggcatgcttctgcttcagcctgccaattccccaaaaggcctttcctcaggtatctctacgacttgctccccttttcccttaagtgtttgtgcaaacaccatttcttcactgaggccttccctgaccactccattaaaatgacacctgcaaccccagctctccctgcctccttcccaacgttatcttcccaatgttctaacatactataccatttatgtagttatttttgtcactccacattgcaatgtaagctctacaaaggcagggatttttattcatgggtgtatcctcaacgcctagaatcatttcatttggtccttatactttcaacaaccttgactggtagttattatacctactcaatagataatcaaatcagggttcaaagtggtttaggtgacttgctgtaagtcacacagccaggaaacagctgtgttcttcactgagcctcagcctcttttcttgtgatctgcacccaaagcaatctcagggaaactgtaaaccttctccaggatctgctcccaagctcaggctctgaaaactcaggtatttgctctggacttgaggtaacaggccaatccccaaatcaaagctcacagtaatcagatatgcaaggaaggctgcctcccagtcccccaactctggctacatgaaaaagttccccaagggtttgttccctggcaggcaagtcactgtgtaatctgaatgcctgataaaattcagttattaccacggagtcatagcctcccaacatgcattcaaaccgtttttataaatgtgcattactctccatgtgtatccagcaggaaaatttccaatgaacactaacatggacacacgatcaaacagagggcattagtagggaaacatacattattcaagcctagctaatacagtgcggcagggggatagccctctgattcactatccctgggagaacaggagcagttccagcaccacaacaacaatttgagcctgatagccctggtaccccagcatcagggcagcagtgggtgaggggtctctatgacccggtgcagcccatttgtggtcaggtctgtggagatggctcagggcacctggccaagtgggaggtgaagaaagagtcttcatcgtctccttgtctctggctctagtgttgctagaggaaggggaatgaggaaggggaccagagcaccacagaggccattcccaggggcaaagctgcttggattttccatgtaggggctgatgtgggcactgtgagatatgtgtggccatgaggggaggcgatgctaagagggagcctccccttcctctcttctcacggttgcattgaggaaaagtctcctgctccttgcctctctcaagggcccagaaagaatccttctgatttctgtgtccaccctctccactcattcctccgcaaggaaagactgcctaacctaatggatctgtgcttaatattcattgggctgcttctagtaatggatgatgtcatcatgcaacgcaagcttgagctaacttctgttcttcctcttttacttcctgctacttagcataggatggagtttgtcaaggtgatgagaactgagtgagaaggaacctgaaaagctgcagggagctccataatgtacatatgaacttggtgattaccgctttgagctaggtctgagaggttatatcaccagtgttgcctgtagccaccacatggtcatcggatgcatgctagaatccacaggtagagtctttgtcctcatcatgttagcgcagggaaatacaggggtcacagctctttgggcaagggttctgcataccaacaacacaaactctacaaaatgtatattcaggcccagctgattgatggtagaacctacagttggcacacaccatatgggagctgattgatgggtcatgtaagatccttcactgaggggtaagctctaggcaagatccacatcaccaggaacattagcatttttttttagattaaatttacttttatttacagtctcttcaaatgactttcctttttttattattatacttaaagttcagggtacatgtgcacaacgtgcagttttgttacatatatatacatgtgtcatgtcggtgtgctgcacccattaactcgtcatttaacattaggtatatctggaggagccaaggtggccgaataggaacagctccagtctacagctcccagcgtgagcgacgcagaagaagggtgatttctgcatttccatctgaggtactgggttcatctcactaggaagtgctagacagtgggcgcaggacagtgggtgcagcgcaccgtgcatgagccaaagcagggtgaggcattgcctcactcgggaagtgcaagggatcagggagttccctttcatggtcaaggaaaggggtgacagacggcacgtggaaaatcgggtcactcccacccgaatactgcgcttttccaacgggcttaggaaatggcacaccaggagattatattccgcacctagctcggagggtcctacgcccacggagtgtcgctgattgctagcacagcagtctgagatcaaactgcaaggcagcagcaaggcggggggaggggcgcccgccattgcccaggcttcagtaggtaaacaaagcagctgggaagctcgaactgggtggagtgcaccactgctcaaggaggcctgcctgcctctgtaggctccacctctgggggcagggcacagacaaacaaaaagacagcagtaacctctgcagacttaaatgcccccatctgacagctttgaagagagcagtggttctcccagcatgcagctggagatctgagaatgggcagactgcctcctcaagtgggtccctgacccttgacccccgagcagcctaactgggaggcaccccccagtaggggcagactgacacctcacacggccgggtactcctctgagacaaaacttccagaggaataatcagacagcagcattcgtggttcacgaaaatctgctgttctgcagacaccgctgctgatacccaggcaaacagggtctggagtggacctctagcaaactccaacagacttgcagctgagggtcctgtctgttagaaggaaaactaacaaacagaaaggacatccacaccaaaaacctatctgtacatcaccatcatcaaagaccaaaagtagataaaaccacaaagatggggaaaaaacagagcagaaaaactggaaactctaaaaagcagagcgcctctcctcctccaaaggaacgcagttcctcaccagcaacggaacaaagctggatggagaatgactttgacgaattgagagaagaagccttcagatgatcaaactactctgagctacaagaggaaattcaaaccaaaggcaaagaagttgaaaactttgaaaaaaatttagaagaatgtataactagaataaccaatacagagaagtgcttaaaggagctgatggagctgaaagccaaggctcgagaactacgtgaagagtgcagaagcctcaggagctgaagtgatcaactggaagaaagggtatcagtgatggaagatcaaatgaatgaaatgaagtgagaagggaagtttagagaaaaaagaataaaaagaaacgaacaaagattccaagaaatatgggactatgtgaaaagaccaaatctacgtctgattggtgtacctgaaagtgacggggagaatggaaccaagttggaaaacaccctgcaggatactatccaggagaacttctccaatctagcaaggcaggccaacgttcagattcaggaaatacagagaacgccacaaagatactcctcgagaagagcaactctaagacacataattgtcagattcaccaaagttgaaatgaaggaaaaaatgttaagggcagccagagagaaaggttaggttacccacaaagggaagcccatcagactaacagcggatttctcggcagaaactctacaagtcagaagaaattgggggccaatattcaacattcttaaagaaaagaattttcaacccagaatttcatatccagccaaactaagcttcataagtgaaggagaaataaaatcccttacaaacaagcaaatgctgagagattttgtcaccaccaggcctgccctaaaagagctcctgaaggaagcactaaacatggaaaggaacaaatggtaccagctgctgcaaaatcatgccaaaatgtaaagaccatcgagactaggaagaaactgcatcaactaacgagcaaaataaccagctaacatcatcatgacaggatcaaattcacacataacaatattaaccttaaatgtaaatggactaaatgctccaattaaaagacatcgactggtaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataatacagactttaaaccaataaagatcaaaagagacaaagaaggccattacataatggtaaagggatcaattcaacaagaagagctaactatcttaaatatatatgcacccaatacaggagcacccgggttcataaagcaagtcctgagtgacctacaaagagacttagactcccacacaataataatgggagactttaacaccccactgtcaatattagacagatcaacgagacagaaagttaacaaggatacccaggaattgaactcagctctgcaccaagtggacctaatagacatctacagaactctccaccccaaatcaacagaatatacattcttttcagcaccacaccataactattccaaaattgaccacatagttggaagtaaagcactcctcagcaaatgtaaaagaacagaaattataacaaactgtctctcagaacacagtgcaatcaaactagaactcaggattcagaaacggactcaaaaccgctcaactacgtggaaactgaacaacctgcactgggtacataacgaactgaaggcagaaataaagatgttctttgaaaccaaggagaacaaagacacaacataccagaatctctgggacacattcaaagcagtgtgtagagggaaatttatagcactaaatgcccacaagagaaagcaggaaagatccaaaattgacaccctagcatcacaattaagagaactagagaagcaagagcaaacatattcaaaagctagcagaaggcaagaaataactaaaatcagagcagaactgtaggaaatagagacacaaaaaacccttcaaaaaattaatgaatccaggagctggttttttgaaaggatcaacaaaattgatagaccgctagcaagactaataaagaagaaaagagagaagaatcaaacagacacaataaaaaatgataaaggggatatcaccactgatcccacagaaatacaaactaccatcagagaatactacaaacatttctacgcaaataaactagaaaatctagaagaaatggataaattcctagacacatacaccctcccaagactaaaccaggaagaagtcgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccgcctcatacctgataccaaagccgggcagagacacaatcaaaaaagagaattttagaccaatatccttgatgaacattgatgcaaaaatcctcaataaaatactggcaaacagaatccagcagcacatcaaaaagcttatccaccatgatcaaatgagcttcatccctgggatgcaaggctggttcaatatacgcaaatcaataaatgtaatccagcatataaacagagccaaagacaaaaaccacatgattatctcaataggggcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatactgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatctccttaagctgataaggaacttcagcagtctcaggatacaaaatcaatgtacaaaaatcacaagcattcttatacactaataacagacaaacagagagccaaatcatgagtgaactcccattcacaattgcttcaaagagaataaaatacctaggaatccaacttacaagggatgtgaaggaactcttcaaggagaactacaaaccactgctcaatgaaataaaagaggatacaaccaaatggaagaacattccatgctcatgggtaggaagaatcaatatcgtgaaaatggccatactgcccaaggtaatttatagactcaatgccatccccatgaagctaccaatgcctttcttcacagaattggaaaaaactactttaaagttcatatggaaccaaaaaagagcccgcatcgccaaatcaatcctaagccaaaagaacaaagctggaggcatcacgctacctgacttcaaactacactacaaggctacagtaaccaaaacagcatggtactggtaccaaaacagagatatagatcaatggaacagaacagagccctcagaaataacgccgcatatctacaactatctgatcttcgacaaacctgagaaaaacaagcaatggggaaaggattccctatttaataaatggtgctgggaaaactggctagccatatgtagaaagctgaaactggatcacttccttacaccttatacaaaaatcaatccaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaacaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaactgctcaccatcactggccatcagagaaatgcaaatcaaaaccacaatgagataccatctcacaccagttagaatggcgatcattaaaaagtcaggaaacaacaggtgctggagaggatgtggagaaataggaagacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaagtgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacactgcgtattctcactcatagtggggaactgaacaatgagatcacatggacacaggaaggggaacatcacactctggggactgttgtggggtgggggtaggggggagggatggcattgggagatataactaatgctagatgacgagttagtgggtgcagcacaccagcatggcacatgtatacatatgtaactaacctgcacaatgtgtacatgtaccctaaaacttaaagtataataataataaaataaattaaaacaaaacaaaacaaaacaaaaaaaacaaacaaaaatacatttcaaaaaaaaaaaggacttctctgcattggttattctagttagccatttgtctaatcttttttcaaggtttttaacttctttgccatgggttcgaacttcatcctttagctcatcatagtttaatcatctgaagccttcttctcttaactcgtcaaagtcattctctgtccagcttcgttccgttgctggtgaggagctgtgttcctttggaggaggagaggagctctgatttttagaattttcagtttttctgctctgttttttccccatctttgtggttttatctacctttggtctttgatgatggtgacatacagatggggttttggtgtggatgtcctttctgtttgttagttttccttctaacagtcaggaccctcagctgcaggtgtgttggtgtttgccggaggtccactccagaccctgtttgcctgggtatcagcagcgaagcctgcagaacagcagatattggtgaacagcaaatgttgctgcctgatcgttcgtctggaagttttgtctcagaggagtacccggctgtgtgaggtgtcagtctgcccctactggggggtgcctcccagttaggctactcgggggtcaggttcccacttgaggaggcagtctgcccgctctcagatcttgagctgcgtgctgggagaaccactactctcttcaaagctgtcagacagggacatttaagtctgcagaagtttctgctgccttttgtttggctataccctgtccccaaaggtggaatctacagaggcagaccagcatcctggagttgtggtgggcttcacccagttcgagcttcccagccgctttgtttacctactcaagcctcagcaatggtgggcacccctcccctagcctcgctgccaccttgcagtttgatctcagactgctgtgctagcaatgagcgaggctccgtgggtgtaggaccctctgagccatgcgtgggatataatctcctggtgtgccatttgctaagactgtcggaaaagcacattattagggtgggagtgacccgattttccaggtgccgtgcatcacccctttccttggctaggaaagcgaattccccaaccccttgcacttcctgggtgaggccatgcctcgccctgcttcggctcaggctcagtgcactgcatccactgtcctgcacccactctccgacaatccccagtgagatgcatccagtacctcagttggaaatgcagaaatcattcatcttctgcgtcgctcacgctgggagctgtagactggagctgttcctattcggccatcttggctccacctccagaatattagcattaagacatcacttccagatgctggggtctcagtttttgagcaatcccagggaagcagtcacaccctgagttatatatagccatcttgtttttttaacagtctgctcaggtgggtggggtgatgagtgatcatggaatgtgcagcaccatgggaaatcagccatgaaataagctcattgaagagctaactcaacagactgggacagaccaggttgtgagagtcagagaacaaaggcaggtctccaaaactccagagtgcactaccagcagacccagtcagaaaagaaggtcaaaacaagaagatgaacaacatagaaagaacatagagaatttctgggatatattcattcatgttgtttgtacatggattttttttcatggagcacccactagccttgtcccaatgatattatactgaaccacttgtctgtaaaaagaagttttttactatcaatgcagtggaggtaaaatggaacctggggctggctcaatggtctggctacaatttaatgcacacccccgatagtatgcttaatattcactgggctgcttctcgtactgtgcccttacccatgcatacatgcacatttctgcgtataacaagcacactcacaagtacatattcaagcacatgtaaacacatggatacaaatattcacatacaaaaaagaagtcatacacatcatacatatattctgtgcatggttttcactgtatgtgaacaaagtcaggactcccaagggaaaagtgctggctgtaactggttgatggaaatcttactaggtacattcatctcctccgaatgataatgactacaggagactgccaggctgctccattcatcctttatattctggttaattacaagacattttcccgctgttgtaaaggttagcgggacacatggtacacatttagctagaagaatctggcaatacaaatgtctctctagtctgcagcatgacttactgggctgagctagtgggagacaaggacctgttaggagaggagagagcaaagggaggcctaacctgtctccaaggctctgggagtcaagaagtggagggaatctgcatcttcttttcttcccaatggattcagacttccctctatgagggtgagcccctccaataaactagatcattccccttgccctgccacttgccagtcttgctggctgaaccatcttttcctttcctgccactactccttctccaaatccaatttgctcagccttatacaatttctccaatgtgtatccttctttcaatgttctaagacactcctacctatactcatccttttttgctagagttttctttgcagattcatcccctccagcccatcttttaaaaagttgcagggggtgatctttcaaaaactgaaatctgaccttgcctttttcctacttgaaaaattgttgggtatacatcctgcattctgcccctcccttgtagctgagggctgccttgccatttagccacctaccctgcagaaatgctttcattacccacagtcttttgccagatgaagccagggtttggcacactggttcctcacctcactcagaattatcccaaagatggacaatgcagtgcacatgcttgagacctaatgcttcaaggtacagaccttctagcaggtgctgtagccattactatgatgccaaagggaagaacagtgattcctgaacagagatagggaagcctcaaagtaacagaagatgatgtgtctgttgcgggtcaattgacttacaagataaatgttggcaccagatttgatcaggatgttgccaacacacaaatgaagagggtggggtggcaccaccattgctactgtactggcatgctccatcaccatggaaggcttggtagagattagcaaaggtgttaatccagtggaaaccaggaaaggtgtgatgttatgtgctgatactgtaattaccaaacttaagaagcagcctaaacctgtgacaactcctgaagagatttctccatttacacaatgtctgcaaatggagacaaacaaatcagcaatatcatttctgatgtaatcacaaatgttggaagggtgtcatcacagtaaaggacagaaaaatactgaatgaattagacaacagagattgaccaagattacatctcttcctacttgaataacatatgagaagtccagaaaggagaattctaggatgcttgggatttccagtaagcagttaattgtacccaccttaaaattgccaatgtccactgaaagtctttggtcataattgctgaagatgctctcagtatgatcatttaaaataggataaaagttggcatttgggctacagtagtcaaaactccaggctttggtgacacagaaagaccaaacaaagctattgctataatggcatggtgtttggaagagagcttgaccctaaagcttgaagatgttcagtttcatgacttaggaaaagttggagcagtcattgtgaccaaagatgatgccatgttcttggaaggaaaaggtgacaagactcaaactgagaaaaatatgcaagaaataattgagcagttagatgttactattagtgtctatgaaaaaggaaaactagaagaacatccggcaaaattttggatgcaatagctgtgctgaaggttgatgggaaaaatgatgtggaagagaatgaaaaaaacagagtcagatacactgaatgttacaggagttacaattgaaaaagatatcatttgggtgttttgccttggtacatttcatccttagattcactgctccagctaatgaagagtaaaaagttagtatagaaataattaaaagaacactcaaaattctggcaatagctattgctaagaattcaggtgttgaaggatcacccaccgacagtcgagaaaattatgcaaagctccccagaagctggttatgcactacgctcagagattttttgaaaatggtagaaaaaataatcatcaactcaactaaggttgtaaaaagtgctttgttggatgctgcttccgtggattctcagttaaccacagcaaaactgagaccactggaattcctaaagaagagaaggatctggcatggtaaatgggaagcagtgttgggagtagcatgttctagttcccagaatagtgctttgtcattattaataagccatgtggggttattcactaacttcggtgaattcagctggagacaatgatgagaggaaagagagatgtttaagaaatcactctagccattggttattggttttgatagcctatgcggcctaagcaatactgttttctctacctgggacattctttcctccccttctctgcctggctacctcttatttgtaggtacccaggacttcactcaaatgttattgcctccctatgggtgtctacatctctcaggtagaagtcattgccctcctcaagacttccttcagacctctgttgaaaccccaacgcactgcaaaatcatgtcctgttcttctagctgttgccccatgagcttgtgcatctatattctgtgatgacactgaaccaggcacacagaagtttcccagtgacagtttgatgactgagtgaatgaacgactgttataagaatatgtgctttaaattcatttcctgtcaaaaggagtgggttacgcttgaaacctggtgaggtcacgggtgccatattttgtgtgcctacatcagtaacaggctcactctggactgaactcacgagctcagttttgtggaccctgggctcctgagccaagcagcaacaagcctgcaatttttgcagagacctttggaggtgcagaacctggaaattaggctggaaagtttagcagatcagcaggccaagaataggacaaaagagtcagaacatggaccacaggatgcctgaagcactttcattctggcctcagattgaagccaagtcacaggcaagaacccaacatgttcaatggaaaacagaagcttcagcttgttattataaaaagcctcaaccatctcagtaaatgcaaatgttttcaaatgaataagtttattctgcagacaattgaaactcagtgcaggacttctagaaggcaaaggagccaatggttttcactgtggaatatcttccatctctcagtcagcagggttgacttggcaagagaggcagtgacaggtataggaaaggcaggctgggatctgactgaagggaggggccaaatgacgatcattaggtcagagtggaaagcaaagagcaggtgtctaagggagagccagaggcaccagctctttctcactgtgcaagggtttcaccatttaacaagtgagtcaaagtgattgatgaatatgaggattgagggttccacttcctcagaacctaccaagtgccaggtattttatactgggatcttctttcatttccaatagccctgtagggttaacaagagcccctctctacagatgaggagggagataatgagggtgctgtcctcccagccagggaagcccctcaccagttgtgattagcaggcattgagtgcattaagaaaggttcttctcaccatcatttccatagacttgaaacattcctggcctggaggcagacggattgattacacaacctcaataggcctaccagaactgaaaaaaaaaaccttaaggaactttaaagtcttgtggttgccaaacactttggctacaggaacttatcattttaacatactcttaggtaaatacccactacataaaatacttcaaagagaaactgctcaggttgaagtaggggtggaaacctgaagtcccacccactcagccactatcaaaccatgctggaggacctgttagtctccaaggaacccaatttgaaaaccacttttttggccctatcctctcatgttatacatggggaggggaatggtggtctcagcctctactttggtttgaacttttcacatcattatctctagcccagacccttcttccctgagctacagacccacagaatagttaactgctcactagatagtctcccaatccctgacatcccaacattacccagaatcaatgtgtcccaagcaaacttcatcccccatctgtttctgccccagaccatctttgttaatatcattttgctaaaaccacttaagctagattcatccctgactccttcatctccttcaaccccatcccctcccactcccaccaaatctaactagccatgagtccagtggggtttaccagaaatacatttggtctgtcccttccttttcatcttcactcctgtttaaactctggcccttgttaccaattccccaagattcttaaccattttctcaatttggattctagggcaaagatcttcctaaaacgaaaatgtgatcacgtctcccctttcattaacaacttctgatcacttctcatctatgactcatggaatcaagcccaactctactgagactttcacaacttgaccactaccacactttccagtctcagtgctcgctacctatcctgcttgcttttctctaggtggcagacttgcctctaggttggcaaactttttctgtaaagggcctgatagtaaatatattaggcctgtgggcctcttgtgtcagtcataaactgctcagctctgccctggcagtgctaaagcagccatagaccaggtgtaaatgaatgagcgtagctgtgtttcaataaacctttctggacactgaaatgtgaatttcatgcagttttcatgtgtcacgaaatattatttttttcaattttcttttcttcaactgttcaaaaatgtaaaacccattctttgatggagggccatagaaaggcaggtggagggccggatttggtctgtgactgctgctttagacgcatggaagtagttgtggttcattagatgtggtagtttcatgctttcttgcctttgcttgacctggaacatatcttcccatggtctgtctggcatctttctgagacccacatttaagtcactgcctcttttttggctttccttaaatccttctggcaaaactaattgcccttttatctctagcccaggaactcttaatcaggcctcaattacagctcttatcatgctgtacagaagttatagatttatgtctgtgcctctctttaacctgttctccttaagagcagagattggcctaggcgcattcatcttttttgctgtcacatagtaatgtcaccccaaaatgcttgttaaactgaacacagttgcctacctcctgataaccagtccgaagcagagcccgactagaactcaggccttctgataccctgtggtattaggtaaaattgtgtctggccacagacatcctaaattctgattggactgagaccagaatataatgtactatgttgtaggttatcttttattttaagtttacttctttttgtttatctgggaaaaaatctctgtcaataccattagaagttggtaatcattagctctgaagtgccataaatcacttaagactatagtgccacaaagctgactgtgggtgaaactgatccaatgccagtgattcttcccctgcccttccaggtccattctttaaacctctctgccctgttctgtgccccaagaagctgatctctgtggactgctagagagcaagggagcctggtggtaatgccagccagagatcccagggcagggagcaggacagagcagggcctctgtttccttgctcttggcttcctgttggattggcagatgggaagcacagtggatgggagagagagaggagagaggtcaagctactgatcccctgatcccctcctcacgccctggctactatggatccctgtggtcccctcctcctgcactgcaggtagggaatagctttccaggtctgccaaggggcagacctctcttctatggctccagctcttgccaccttcttccctggtccctttgcacacctagtggtggtgtaggccacctgctgcttagtcctcaggggcctcaccatctcttgcgggctcctttgactccaccctcacctctgtacattgtgccttcactaaaccctctaccgttaaagctgtgcagtattcctcctgtctcccgctggacccctgactgaaatctatttctgccactgttttagggtgtatttgcaataataaagcttagcttggtctttcctggctccagagtttttattccttcagagtagtagttgtcaactggaggtgcttgtgcacatagggacatctggcaatgtctggagacttttttggttgtcatgactgtgtgtgtgtgggggggcgctgctaatggctgctggtccctgtggctccctcctactgcactgtgtctagcatctaatgggcagaggccaagcacgctgctaaacatcctgctatgcacaggacacttcctcacaacaaagaattatccagctcacaatgtcaatagcgcagagcctgagaaaccttgctttagaaagtcaacaatggagttactaaacgatcactgtatatccttgcactatgcggtctcagtcaggaaaacactagaaaaagcaggtttcaaggaagaatcatttattaacagaatcacaataattgagcatgccagacccaaatcaacactgctgggctgcaaatcctggctcctacatactattaatgagacctgagccagctagttaccctctctatgactctcgttcctcaactgtaaaatgggacgggtaatagtatctccttcacgcagttgctgttaggattgaacaaagtaataaatgccaagcgcttaaaatctagcaagtcctctttatacactggcgcacactaacatgcaaaacttcattctgggctatgctaaggatgatagagggaacagagaacagggcctgctttcaagaagtttgcaactaaaacagtgctttttagattgtgagttgttccctgctgcagatttgtaaaattaatttagaggctgcaactagcatttaaaaataaaaatgacattttcagactacattgtacacagtaaataccacttggtcatattttccttttagctctacagatatatgcttatactgggttgtgattttgttttttacagtggggtgggatgagcaaaacaaagtttgaaagctacggttaataggaaatggaagacacccaaagcaccatcagaggaggccctgtaattctgcaaatacagaatgaattagagctttacagctcacaggctgtgtgatcttgggctagttacaacctctctgagccccagcttcctcagctggagaaaaaataaacagaaataaaaacaaatgtatcactttactgtggggagtactgagtggggcaatgtacatacagtgcctagcacggggcctggtgtgcacagatgtggaatcgatgtgtgatctggagactgccaggcttgggttcttgtcgcccattgctggcatcaaaccttaaccttaaaaactgacaaatgggccctcagtaacttgaaatattagaaacacccagcacttacttaatcagatacaattatagcattcatctctgcttttgtcttttgagaaacacagcagaaagatacagacagctgttccactcacacaaagacccaacctcagcagtggaaaaaacatctccaagaaagctctcagggtaagcctttgttaagctactgaaccaagttggtttcttgtttactttctagatatttcaaatgggtacaccacccaaggctaagtaaattaggccgttcctaaaaggttcagattttgaacgtaacgcttcttccttcagagctgcttttatcccagtttccagccagaaagcctggccctaggagccttgtggagggggcactactctgccctatgctaccttgagggtgagccagcaggcatttggccttggagcccagggcttcacacaggtccttatacttaataggtacacaatataagcttgctgtctattctattaaaaccaataacaatttgagagtggtaatagctaaaggcttaatgagcatgttatgaggccaacccttggtgtttatctctataaattttgagtactttgaataaacgcaatgtcgaaaaggaatgtgctcatccgctcccatctatcagctggatttttggatctcttccagttacagacagctccttgcttctgggttaacccactcctttttataggtggttcttgggttgggaaattcttcattattgcagcagaaatctgcttagctgcgatctccacctgccattcctggtctgatctgttgccactagacagttcttcacagatttgagcatcaaagctatcatgctccctaaagtgattttggaatatattcatgttttagataaaatgaaaaagagtagaaatgtaggctgcagaggtcagcaaaggctggtggttaagagggtgggctccagactcaaaaggcaggagttcagatggccttgggaaattggcttaacctctctgggccttagcttccttgtccataaagtgaggtgatgaccgtgtttcctttgcaggataatgatgaagattaaaggagatgctacttgccaagtgcctagcactgtgcctggctcttagcaggcatctggtattaactattatgattagcctggcatgtgaggggcagctccagctacataatttgggaaacatccctctctggggcaaaagacaagggcagatgcagagatgcaaatctgcagacctctggtctgcaaatagaaacgtacaaagaaggcaaggatgcctgaagccacaccggacccagtagggagaggtgatgagccctccaggtgtcatctctgctgcccactgaggaagccagacagtcctgggacctgcctaccttggtattgggcactgaatccgcgctgccggtggttgccatccgatgtgaagtgcagtcgcagccagttcttgctgctgataacgggggctgggaggctggctccggtgaacctgtgggaacaggaagcagatgggctcagggaccagagctgagtggtataggtgtatgagcattcaggagttcctccacttcccttgagtgccaaggcctcagcccagctctggagcaggaagggaaggcggtgttgccccaggcccctccagtaccctaggcctgagcagcttgagatggctcctccagggtctcatcccactgctgggtttccctcagctgctgggaggaggcaactgatccttcagaccacagcacctcctgcttaaattccctaagcattccatcctttttcttttttctagttctttgccttttctgcttggaatatattcacctgtaacgctttctcctgcccatccatgtcccccaagatgactttgggaagccccttaagtatcacatctgcagtaaagcattccctactctccttggctttgaagcacagatttgggttcttatccaggtttcaccagtgtgaccttggacctgttacttaaccttttggagaacaggagtaataccagccctaagagtttgtaggaataagtaagaaatcttacgcacaaagaatcgaggtcagtatctggcacatgttagcttaataaatataattttcctttgtcttcctctgtgatgccacaacattttattcaaattataattcagttatagaagtgtgtggtttccttaagataactcctcaaagggggcaatgtggcctagtagtgaagaaacttgagctctggagggatcagctgtgtgagctcaggaaaactacagaaaccctctgagacttagtgaccttatctaaaacatggggatcatgatgacccctccctcaaaagcttgcaaggattaaatgagataatacacaaaagaagatctcagcacagtccctggcaataacaagctgtcagtaacggcagctgctgttccattcttcatcttgatttccagcttctaacaccatactggacacaaagtaggcatttcagggttccagcagaaaacaggtgtcacagtcatgtaagaagagtcccaggagtttgatgagtgactcttttgcataggtccttataccctttctctatactctttcacataggtccttatatcctatgtgaaacagtcattcatcaaactcttggaactataaaggtgagggccgactatgggggaaccacccgggaggggcagtatcctggggctggcaactgagggacttgttaccactcccaatcctggagcagagagaaaatagttatctccaaacagggggctgcatgtaagaagacaccatataggacccagatcttctttcacaatctggggctatagccaatttgtgaaaagcccatcaagaggaggcaaagaatgaatacgcagaactcactctcttccttcccctcctccagtctcccactgattctcctgttgatctagcccaactggaagccagagagcaagagagcatactgatgcagccccttaggtaagtattctcaggcatggagcaaggagaaggcaagggagaggatctggaggtgcaaatggaagacatccagcatagtgggtcttcataaatatgcattaaacaaaagaactaaccaaggagcttcacgcactgcaaaactgaattcttactaaatgaaaatgctgacacacaccaaacttcaggaatataacccataccgctatggtaaaaactattataaaaaccaattactgtatttcaccagatcccatttaaaatagtttattacagactgagtcatttaagttttctaaggagccacaaacgtattgtgggtttttttttttttttctccaggccaaattcaattctatctcaatgacaaagcttggaggctatttatataagggaagtagaagtagggagaatctacctgaataattcaggaccaaaagctctttattgcaaaatggaatgaggggagggtgctgaggtctcaagagcaggatgagattaatgatcaagattgcagcaggaagtcagtgagacttccccggcctgtgagatcaggagaagccctaaggggcatctcccacctcccatttctcccacacatttacccactcctagaaatcctgttaactgttaatttccgaggcttaaactctcagggccctgtgttgcccatgcagctttactctgttctgctcctacctccctggacacaaatgttgggcagttgagagttttcttggcatctatcaaagaattgggggcttacatggcagaatcatcacatcagactctgccattgagatggtgtcatgccttgctcgaaactctccaatgaaaggaaccagctaccaatacctgcaacatggatgactcttaaaagcattatgttgggccatcaaagaggatatactgagagtatatactgagtgactcattcatatgaaactctgcaaaagagtttagtgagagaaagcagattagtggttgtcagagctgggggtgagagataaaggttggggactgcctggctgggaaatagtgcaaggaacatttgggggtgatggaaatgtcttacatctcaaatgagatgttgattagatgagatgtacacattgggcaaactccaaggaactgtacatttaaaataggtaatttacagccagtcacagtggctcacgcctgtattcccagggttttgagaggccaagcggggaggattgcttgagcctagcagttggagaccagcctgggcaagacagtgagaccccattttatttacctatttacttatattttggatagcatctccaaaatataagtaaataggtaaataaaataaatggtaattttattttatgtaaactatattataatagagttagtgaaaaacaaatcaaaacaaaacgaaccttcaatggatccaatcctcagggtaaaagaccttattatagcctataaggccttgaaaaagccactcttcctttccttttcctgcctcctcctctttaccctttatgccccagccacagatatctcctcactgttcaaaactggccaggcctgctcctgcctcagggtctttgcagttgacatcccttctgcctgctacactggcacttctcccagaactccacctggcttagcccctcgcttcctccaaggctttgaacaaatgtcaccttctcagtgaagccttcccggtttgactcctgcctgcctttcaccctgagtgtgcacgcacacacacacacacacagttctcccgtcaaacagaagagttcatgtattcaggaatacacgttgttcttttgtgcttctctgtctttgcccttgatgctctttatgccttttctcactgtaccacctggctgcacagagaggtaaagaaacttgttcatggtcacacagctattaagtggcagaggtgggatttaaatccagccatcccatccagagcctatgcattcagccactgcattacactcacatgtacatgcaagcatgaaggaaggcagtggaatcatttaggctgaattccattctgttcctcttctcccccctcctgacttcccccaggatcctctttaattttgctccctcttagaatcataattaaaggagagaaacacaaagagagattctccctttcaaacctttctgtccacattaacttcactacggggggcttggggaattccaagttcacccagaaaattgctattgcagtacaacataaaatgtatttaagcaattacactcaattttttttttctttttggtaaattgacttctgttaagtggggcttcattaatggaatctggcttgggaagaattaaaaaaaaatcactccctgtaatgcatgtagttgattatagaaaagtggctttgagctcctctgcagaaagctctgagccattcccttcatgaagaagagctcagagcagattttgtgggaagcatttcttcttaagaagcttctcatgcagtcgggatgttggggagctgagagatacccccatcaagatgacaacagtgactgtgcaaggaattgctgcctaattgtaagtcgagggggaggagtgttaggagatcttagtttaaatcttagcatccctgaaaactgacatcttcaggagaacattcattcacgcaatcaccaagcacatattttgtaaaaggcactgtgctcgcaagtgagggccactcccactgtggttccctagatatagggagtccctgaaaagcctgtaatgtacacgattcagctgcaatgccttcttttctgttcagcctccattccttctccatcaatagcatctggcttctgtcctcccagagcatctcctgtgggcattatctgttaagtaagctatgtgcatggccctggtctgattcagagttgaagcacttctgcatcccagtactaagtataaaccatccctccccatccccaaggctggcctaggagaatgtgaaatataggaggtcctcaccaccttatccccactcccaagccctcttcccttcccacctgtcacctgctttcctccctgatgaatggagaggacaccaggatacaatcagagaaacccttttgaaaatgtctttgtcagtggtgggcaaatagtcccaaggcccttgtttgaggctgatccctcctctgccaaacctaagccacctctcattcctgaagcaaacctttaatgactcagccttgacacccattcttatcaaaatgctttccaaaatcagttttcctttagctaaactcctaggacttgctatgtcaagataaattctttccccaagacaatcccatgatgttatatattttccaggaactgagtgaatgcctgggacaaatggaagtttcttttgaatatgagttgctgggccttatctttgaaaagaggcccctcagcctcccaaggcttttttttttaccagcagtgcctgcccaccctggttgtgtggacagctctgaaagatctgagccagcctttaaagattcaattcccggctacctagtatgtgtttggggttggttactatgctctgaacaaaccaaagctttcccccagtcgtttctgctccttagtgcaactgctccccctaatctacaccatcctcctggtcacccaacccaggcagcatcctcaactccccactctccttcacccctatcgccaattgtggccaagtcttctccatttcatgtcctcatcgtttctcacctggactacagagatgggcttctgatttgccctctgcctctgatcgatcttccatactttgtggggaattttgatcaaatccctgcattgctggaaagccagcagcaatggttgaacccactggctccagaataaagtccaagctttttaatgtctttcctcttcaatgacacacactttgagatccagctacacagaatggcttgtacatcctggaatgcgactagtactttcgtgtctccagacctttgcacatgctattccctctacctgtaatgcccttttcctgttgccccacctggctacttgggaaaatatcactgatcctataaacctaactaaatatttcctttcctctatctctccctctccctgcccccagtggacatggccctgccatgatcctgggcataccaaattgtactcatcttttgagttgaccatctcttcaactagcaggcaagctccatgggagctggaataaaatcttctttttgtctcagtatctctggtgcacagcacagtgcctggcacacagaacaaatacatttcatagaacaggggttggcaaactatagcttgctgcctgtctttgtaaatatggttttaccagattgcaaccatgcccattcattcatttacaaattgtctgtggctgcttccacattgcaatgacagagttaaggagttgtgcaagatgatgacttgcaaagcccaaaatatttattttctggcttcttacagaaaaaaaagtttgctaattcctaccatagaagcctcacagatgatgtagttggttggtaaataaaaatttaatttctaagtagggaatcataaaaaaggacacagatgtagcttcaacatttcattataatgtaaaacacttaagcatacatttatttgccaatcagtttaatgcaggaccaaggccttccctttgatcatgggtttgttctccacattgtctgtcttatataaactacaaccacaatgcatcattcaccatttcaaatgttgctacagatcgtccagccaacaaatatttcttgagcacctactatgtgccagaaattgacatccattctcatcaaggtgataaggatgctttgtcccatccccctcccctcatgtaatttacccagtggggtacagttgtctcattcactcacacctaatatttagtaagcaattcttttaagagactctccttcatggaatcattccaaagcattcaatttagtttccatagatgcaactatatttcctttcacactcatatttcatcagtttatgtgatgtttaatttaaatcacataattacaataacaagtatgactggcactgagagacttggcaacaaacccaactgaatctcggaaagtgcaagactcagctgataggagcagaagtgcacaggcattgagggtgggggtgggagactgcctgttggcagcagttgctgggggtgccatgggcaccagtcaggaagatctactgaggccatgggagtgctgggtagtccagctggcttctttgggggaggcagggtgggttaagaacacttttattggacatgtttgtgaatgaatgaataaatgaacaaacagcagtagcttactttcagtggtgggatatcgaattacatcccctctgctatcaggagagtgggaaccagctaaccttaaaatctgagatttgagaaggacttcaaaggtcttctaggtctaatgcccagctatatttgagtctcaaccacagcattcttgaaaaacggtcaattatgatctattttgaatgttcccaacaattaagaatttaccttcttgccaaattctctctcccaatcttgatccatccccattcttttcttagctacttcctactcatcgtgcaggtgtatcagcccctggctcaggaaacctgtcctttgttgctaggtctggtttacttctcctttgtcccctctgggcaccctgcactttctccaccatagtgcttctctcaccatgcattgctgaactatgagctccctgaagacaggagctgtttctttctttggtaccttggagagtgcttgacataaagaaagggctcagtaaatatcactcagtggaagaagggatgattggccgaatgaatgaatgaatgagagcctgctggtgaaagcagaggttacatgtggggaaaagcagagaaagaggcagtgagcaggtgagccagggaataggagggagggcctccagtgccacgcgggcttcacccgggtttcccatggcactgcccactcctgtcaagacatgcttccccagtcctagttcctcagctctggctgtgccccactacctgcttcacttagcagctgctggtaccttcctggggattcttctcatgctgacctatccccaaagcagcaacagtgaggtctgctaatcaatgtgggcaaatgttcccctttccccagaagcaactcaataaactcaacaaattatcagaactctttcttgctcagctaattgttagctccagggaacccacagaaaccacatcaggtaaatgtttttcctccagatgcacggctctctggaggacacatgtctgaggcttggagtgctgaggaacagggagcctggctgttgccgggatgagggcttcctcaccaacacgctgggtcttgtgtatggggtggtggcatattgcgaaggtctaggggtggcttggtgtgtcagtttccttccattgctagctcagctgctcagctggcagagctgatgggtaaggtgtttcctgcctctatagagaggatcttcccatcgtgctgaagtgacagaacagggttgggtctgaagatcagaactggtgctgatgccaagctctgggtgaagaggcttgtgggtggatccccagctgcttttctgagttgcccactccgtcctttactgtctccaggtctaaatcaggcagttctactctcttatgaagaccagaagcctttgaagatcagtctccttccctcaacccacagctcctgacaggggtagccatgtacatcatatgacccataggctacagctgattggatcctggtggtcatgtgtcccaagctgggccaatgagctgatggaacttctatcaggaaggtaggtccctatggcccccatttgaggtttggatggagagaagggctgagtactcactttaatgaggagaagaccccacaggcttggctttcccaggggagatttgggaaatggtgtcctagcatcatttcttccacttctgttgctgcctccccaacttgcccttattacttttatatgatgtcctgaaccttgtacatttatcctccaggagtcagtctgactggacagaatctaagagcagtctccactctgaccagctgctgaggctttagctggctgtcccctgtccccagcccaagtctctattatatgtcagatctgagatccgggaaggcagtcctgaggactggcagcctccatgctctaggatgttaaagcctatccccatcaggcttggcccagaaacagggtgcaggcctcaagagcgtggtgactacagcatattcacactcaactctactcaaccctcttcttcttcctgactggagtctctgcctaagtaaagatgacacctatctggctcatcacctgtcttgttcctcacagaagcaataggtttaaaaaggttaagggttaagggccaggccttcggaaccagacagtgctatatttgaatctgcgttctactgtttcctagttgtgtgaacatgggcatgcaacgtaacttctctgagcctcagtttcctcatctgtgcaatgggattcctctgagcagcagtgctcatgtgtataatgtgtccaagtctgtgcctggcatacagtaggtgcctcacaaatgtgaactattttccccctgccttgctggggtttgagaagaggtggtgggatcttaccaatgccttgaacccaacccttcagagtagaccgcagagcagcctggcttagttttctccagggaaatgaggcacctgcatctactctggtgatagagcagtgcaggggtagaaggacagggcactctgtggtacccagaccagccagtacacctggccatcaacttccctctttctctggggaaccccagcctggcctccactggctcctgctttcccagccttgcccactttccacctgtcactggcagacatgacttggagaaggaacctgcttcctgccatagagggtggcaccgcttgccttgcagaagcctccgctgcttgtaattagtactatttctcacccagagggactgttgtaaatggcttcttgaggagctgcccacatcagtgtgtgcctgccacttaactgccactctgagtttgagcatcatgtatgtcccttcccctgttaggaggcagctagtggtccctgccagagatcagcagctctgatgtccagaagaatgagtgagctgcccaacagctggaggatgggtgggctaaacatctcacacacactaaggctagtgagcaagtggtcctagagtcccatggagctgagttctaatcctgccttcattgtctgctggccatgtgaccttggagaggtggcttcacttctctgagcccttctttccccagtttatatctcatagtgcgattgtgagtgacgctcacaaagttccctctaaggcctcaagacacgacatctacaattcttggccctgccatatctctgtacagcaaggtagactcgtaggcaaagggaataatatttactgagtagaaactaatttggggtagagacttagcacgcaggccctagaagaagactgcctgggttcaagtatcatcagctctaaacttactgtctcactttgggcaagtaactgacctgctttaggcctcagtttccccatctatatagtaaggataataacagcacccacttcattgagtggttaaaaggtttaagtgaggtgatgcatataaaaggtgcctggcacatagcatgtgcccaaaaagcatcaaaaatgggggagaggagaattcctctcttcttgtattgcttgctgccgtccacctggattaatgccttatactttggctttcagatgggagaaatccagatcacatccacctacagaagaaatgattggctgctatggattgtagctaaaccataggaagagtagagttgtagctggccccagggatggccagaaccaagaactcagatgctacaaaggccctctctcggtgccccatctctgttgtgctctgcctgctggcatcattctctctactgcaaatggcggctgcttgaggctggagccatgaccacccttagtagctctgtgattcactctctcaccttcaccactagagagatgacaatctctctccgtgactctaattagaaaaagcccatcagaggcctctgattagtttagctggggaatgtacccattcctggggccaaggaggtagcctccactagaaccccatgactagtttggggacaattctccaaaagaaggaatgtgctcaaaagaagtgaggagtgctaggcagacaaaacaaaagatgtctactgtggatgaaagagaagtaggtggactgaataatcagggccactctcctatgctataaaggagtaggtttttaaagacctgtgaggagtatccatagatcactgtgtgagttatcaacccagagttggtcttgttctagatctgtcctgtatcctttcataggtagccaggcatcccccaaccaggctgatcccattctgtgtctaatcatctgaccactgcctgcccacctgcccactagtccattgggctgggtgctgacacttcgcctggctttggcaagcctctgcccttgggagtagatgcaggctccgtgcttatcttcagatgctggtgaagttctatgggtcatccaagtcagttgacctcctggacttagaacatcccatgacctagagataagttgactagatctatccagaatgaggatcaacccagattagaaaagactcacctgaatcttttaaacgttgaaatttagataactttttctccttccttcttccctcctcctgcaatacttggccttgttccttcccagttgcttccttaccctagccccagccaagggagttcctagactaccagtagaggctaaacatatgagccaaggggtcaaacaagcttgagttcgaagcctggctctgccacttattgctgtgtggccttggataaattaatctctcttttcacgcttccaggcttccagagatgatgtacccaaagtatgatcatcatttttattaaaatattgtgctcacatctgattgattaacagttcctggcacgaggtcagtgccaaagagccttggactgactgcttatggcctggcctccctatctggtttcttactatgtagcgatccaagtgaattcagatgattccctggactaccaccctccttcctgggacacatccatccctcaaacactgttcatcactggccatcaaagcagcagccacactgctccagcaactcaacagctatttattgagatgggtgtgtgagtacatgagtgagtgaatgaactgaaagaacgtaagagtgaattaactgctaagtgaattagtgaattagtgacttaatgagtcagcgagtgaagaagagtgtgcaggattgaatatatcatgttcttttccctcaacaaattgaatatgccgtggtataaaactttcaccctcaaatgtgtcttcttcattaacacaagcaggggttaagaatggcagaagaaaagttacagaccagcagccagaggagaaagatactgtgctagtttcctattgctgccttaacaaataactgtacatttaagggcttaaagaacacaaatttattgtgttataattctggaggttagaatccaaaatgggtttcagcaggccaagatcaaggtgtggggaggactgagcccctctggtggcactaggggacaatccttttgcttgccttttccagctgctagtagccacctgcatttcttggcttgtggcctctttcccttgtcttcaatatcagcagtgtagcatcttcaaatctctctccacctctgatcctctgcttctctcatcacatctcctctgactgtgacactcctgccttcctcttacaaaggccatgtgattctatcaggcccacctgataatccaggatcatctccctagctctaaatccttagagtaatcttatctacaaagtcccttttaccaagtaaggaacaaattcacaggtttcagggcttaggacgccagcatctttggagaggcattcttctgccacttgcagatgccttgttcagagggtaaatgcaaccagtgagtcccactccacagaggaaggggcaggagggggatgaaggaagtttcaaagcatttgacatacacatgcttatgccaggtatgtttgctgttgttgctgtggcctgagcactgagggttttggaaagcttaggtgattccatcatgctgcaaaatctgagagatactttgacagagatatgctaagagcatatgctgctgtaattgagggtaaaatctggccctgtgattcctggagatgatggatcaagagcagggtgtctttaccctggctgcacattgctatcaactggaaagatttttctttaaaaaaatgttattttgaaataagagtgcaaagatcatacagaaatgtcctgtatacccttcaccccgattccctaatgttggcatcttacataaccctgggtcatgcataaaaactaagaaatcagcaatggtacagtactattaactaaatgaaacattttattcagatttccccagatttccaccagtggcccactttttgtctgtcacaggattcagtctagcatctctcattgcatttgtcctgtcttcttggtttcttccaatctgcatcagtttcttagccttgccctggttttttaaaatcttgacattattgaagggtactgatcaggtatttggtagaatgttctttatttcagtttgtctaatgttttttcatagaccttggctatggatttttgggaagaatatcatggcggtgagatgctgttattatggcaacacagaaaggggttctgtgatctcaacatgacctgttattgatgatgcttacttcgatcacttggttaaagtggtgtctgccagatttccccgctgtaaagttactatttgtccctttccatgttctattcattagtagtgggtggctaagtccagcccacactggagagggggagtgccatctgtttttattcctatcatttcaatttgtttaatcctcatggctttattatcacctcactactttttagagatatggttgtaatgagctagacttgcccaaagttactcagctagtaaatggcaaagctagaatttgaacttatatgtgtctggcttaaaaggccatgttctttccacttcatgttactgccaccaagtaaagaggatctcacagtctctgaggcggaagctccctctcagcttgtctggacagtgtttttcaaatccattcttggagtgtgacccatcagtgggtcatgaggtcagtctgtgggtggcattttaaataacaacataaagtaaaggtgactacaacagagtagaaaataagagtatgtcacacaagtagaaattttttatctctatatcttctctgtgctttgctaccttcatctgaattcacttatccttgtatggagataaaaatagccctcccataggcttgttatgaggactgaatggaatgaggtacataaagtgcttagaagagagactggctcatattaagcattatataaatattaagtatgtatgtatgtaaacgagtcatgatgtaaaatgtatttcttattgcagactgcaatcaagatgtttgaaaatactgaactcacatctgtagacgaggagttggcagatttacgacccccagcttgcagcctattttttaaaaataaggttttattggaacatagccacactcattggtttaggtattttctatggttactttcgaggtatagtggcagagctgggtacctgcaacagaaaccctgtggttcaccaagcctatcatatttactacctggccctctagaccaatgctcctgcctggaggtcatctcataatctagggaatattggacacctcttcccgggcatgtggtctggtcatgctactgtccttgcaggcatgcttgctctaggctgtgtgactgccaggcacttggatctccagaagctcattactcttctctattaaactgatgcctacatggtgaaaggctaaaaccatggtactttggtcagggtccccgcaggaaacagatggccactcaaattaaaatgattggtgagggcagagtgtgggaaagtagcagagacctcagaggctcataaaagtagagttttaccaccctaggcaggaggagataaagaaagggggcaatgcctgtactggaaggagagagtcatttagagaggacaccttatgaggaccagtgaccttcagtccagggacacagaaccagctccaagtgaccctggggtggggatccaggagaataaatgccttgacttaactttcctccatctctgatctcctgagggccccattgaccaaagtgagatggaaaccagagggtatgggatcctctgatgtggctcatacagaccagcttcccaggccagagaaggttgaagagaggttggagaaggctggaaaggggatctggaagggcaactcttagatacccagcacacagcattgatttaggaagccagatttatttacctttcctaagctcccctaaacaaggacttcccctgcttcatcctccaagttggaactttgacaacaccaaaaggttgacatagcttttcccttttactgccttttcttcttaaatctgctagcttcccgatagctattgtgggttaatcttcctggatcttatcatgagagggatggaaggttaagaggcacagataagctactctgtgtgtgtgtgtgtgtgtgtgtgtgtgtgtgtgtgtgtgtgtgtgtgtgtgtctgagcctgagcagagtctgatgaatatgtggactttcattaaagttcttcctcatgtcccatcttttgatctcagaaaggagctgtgtcccattcatctaggcagccctgctcatgtccaaaaaatgtgtgagtcaacctctggccccttgggagaaagagccagggggaaaaaggctacctaggctgagaagtgtccccagagtaatccgttcctttgcgagaccccctactagcccagacttccttgatggcacctgatatcttataggcccccaaatcctgccacacaactacagcttgtcccctggaggggcttccctggccagtccagaatgctcaatttatgagagatcattggctcacagggaggaaggggatggcttaggtaggccagccaccttgcagcagagctgggcaagaattcaggattggagactcttattagtttccatctttcttttacagaagatgaacactgaagtcttggaaccctgggaatgaacctggaaaaattcaaaatatggtctagtcttaggcaagtttccttgtccggctcagctgctgagaccacatatctggaccctcagtgccctggcaacagctctgtgcaggcaggatgaagcacaggcttaggtcaagcaatcagccgtcaaaatccacactctcacctgtgagtggctgttcaaccttgaacatgttactttttatgttaatgaaactcagttttctagtcctataaatttggggctatcatcaaccattaagtgatattaaacccagtgccacacaggcaagtacctagcagtgtccaaaggcccccagaatgacactttttcatcttttctcttccctccaattgaaagactagtggaatatctgcaattactttgaccaaaagccagaagccggccagtttgagtgtagctgttacagctttgtgttctaaacctaagaaatggggacccctcacatgagagtggggaggcttctggatgtgctacaaattccatttcattttcatgaactccagtgttaattaataaaatctcaaggttctcccccctctttcgcctcacatttcttcagagaaatgaagagttccaactcatagcccaagtgctcaggttttaaattagacaactttgtcctgacaggaaccaagtcacagctgtcatacctgattacttttagagttactactaaaccctttgtatggcatgagctgccactgttcaaggcaaacagaaacacttcacattttatcatgacagccctggatctatccacctccccatgttcattatgctcagcctgtctttggaagggatgatgaggcatcctgaaaatcgtatagtgaggaaggcagaccccatggcctgtcactacagcctagggattttaagcccctaaagtgcagcaaaacccactgcctccaggaagccaaggagaattatttctgggggacatagctgcctcatagcctactatgaatgaaccatcatctttcatgagaggcaaacattgaccctcaagtaaccaaccaatacgagcacctgtacacaaatgcccacaggtgttggctgggattggctggcttgtggatgatgtcacagtttccctcctctgactcaacaatgccatcagcactgaaaaggctgagccctgactacagctcttgcagacagaaaaattcgctgcaagtacagcactttctagattgctcctggagtgtgggaacaacagtctctcctgtccacgttactgaatccagaaaaaaggtgaacttacgaacatgggaaaagaaatccagctaaagcctaaggcaaatgtctcttcttacgttcactttttgctgaattacagaaacaaattcaaggagcagcagccaaatacctatgttggctttaaagagttctctagaaagtgttcggaaaaatggagatccatctcaaagcatgaaaaggccaaatatgaagccctggccaaactcgacaaagcccgataccaggaagaaatgatgaattatgttggcaagaggaagaaacggagaaagcgggatccccaggaacccagacggcctccatcatccttcctactcttctgccaagaccactatgctcagctgaagagggagaacccgaactggtcggtggtgcaggtggccaaggccacagggaagatgtggtcaacagcgacagacctggagaagcacccttatgagcaaagagtggctctcctgagagctaagtacttcgaggaacttgaactctaccgtaaacaatgtaatgccaggaagaagtaccgaatgtcagctagaaaccggtgcagagggaaaagagtcaggcagagctgatggatccagtttgaaaaaacaaaatgccattcaaccgtatttcctgttcctggtctcatgtgtggcattagagtagctgtgactgatgctttgtggaggagggagtggcttggtagaggagagactgatcctgaggaggggaacggagaggacgggaagggaaagaaggggaagggaggagaggagggaggggaagggaagagaggggaagggaagggaaaggaggggaatggaggggagggaaagggagggaagggctggctttgagagaagtgtcagcagtaaacaaaaggtgtgacttgggccactgggtgggagcctccaggtgtaaagtagcagcagtcatggaggtagaagcaccgtggttctgagtggtgatccaggtgagaggaccctactcagtgtcaggttcaggaacatgacgtctgactctgctaagcagtggcaggactgggaagactgccagggctagaaggcctagagttcaagctcacacttgaggccccaggagaaacatatggcatctgagttgagacaggcctgagggaacccaggatttccagcaacacttagatacgctcagtggggccagggtgaactcccaggggtgttccctaatcaggaggaggcaaggggcagattttaccaaaaaaaaaaaaaaaaagcagggggctggggaaccagatcaatcgtttttcagtggatagatgtataatatgtggcctccactcctcttcctcttgttcatagcactctgactccctttcgtgaccaaggctggataagagggcaggatcgccttggccacagtcattggctcagtggtgggcatgtgacccaagttggtcctatcagggtggacctctggacctgtgtaaggagtcctgggggacaccgcagtccagggaatgtggacagccatttgccatctcatagggcccaagaaggaggccgagatgctagaatccctgtggcatcagaacagtctcctaaacttttcattgaagatgaacaacacatttcattttttccctgacatggtttgacttaggttttttcctacttgactataatttgacacaaatgggattgtgctgtaagtgtctgtctggtaactagatttttcaggcaagaatatactgtaggcaacattccataccaatcaataaagattgaaatggaatattttgaaatggttcttctgacttcttgacatcaaaaatactgggccaaaatgcaaagctgcttttttgtcaccagtttatacatgcaacagatctccctaactccacctctaaggacccctattccatgatagagggacctacactttctactctactgcgctgaacagtaaaaatacatatttttgaacagtcttttagaactgcatgagcctttaggggatgagaggtaatacagtgatttagaaattcagggtctggaatcaaacaggtcatttgtggaggattttcatgtgccaggccatttgctgggtacagggaggcacattacgcactactgctaagttcccgccctataaaaaatttccttctgacaggagagatggacttgggcataaattgcagcactgcaaagcaagatgatgaaagtgaatgcagaaagtaatgggggagggactggggaccacccagcaagcctgtgctgcagtcttcatgaaggaagcagccttattccacttgacaactttgtaggcatgctggcaaaattcccgttccgcattccccacagctgctattccaacttggctctgcttctcttccctctcaggagacgcccgcattttctgcttcattgagaaaatagagatcctcagatataagtgctctcagtttccttcattcttgaaatgtaatccataccaatcctttcctcctggtctcacccctcacggagagctatccccctcctgctcttcctgccctctccctgcctccctggggcccttgctccttactataagggtgctggccctccagcctgtacactcatacaagttcacttgatgccatgatatggtggtccccaccttaatgttggcagaacttagggcaagttctcattcctctgagcctcatgttcttatctgtgcaaggaggataatgcctgccttacaggttgttttagcaattaactgaggtaatacatgtaaaagtatttggcacagtcctaaatctaataggtaatatagcggatatactctagggtggctgttccataatcctttcctcctttcttggtgttcacacccttgtataatcccctcctattaagtgtgggctggacaggtgactttcttctaacccatagaatgtggcaaaggagatgggatgtcacttctgtgattatgtgatgataaataatactatatattgctagccactttgctctagggattctccttgctgcttgatgaagtaagtggtcaagtttgagaagcccatgtggcaaggaatgacaaggaactgtgggaaatgtctagaagctgagggtggcctcagaccattagccagtgagaaacagaagttctcagtccaccaaccacaaggaacttaatattgcagcagccacacaagtgggtaggtgaatccttccccagtcaagccagcagatgagaacttggccctggctgaccaaggcctgaagcaatgcacacagctaagctgttactggactcctgaccccacagaaactgtataaatgtaagtttaaaactataaatgtttaaaccatatgagtgtattttgttttaagccactaagtctgtggtaatttgttacacagcaatagagaatacattactcaataaatgccctcttccttataattctagaagagactgtctttaatcttgtttctatctccagcctctaccttccccatttaatttcctttcctttgttaccaatctcttgttaccaacatcttgaaggtggagggccacctcccaccgtccagtgctaattagatcctgatttgtattacccagtagtagttccagttgggttgtcttgtttccagcctgaaatgtgggctcttggtgggcagcagctgtgtgatgtaccacactcctctctgggaagagggcccccacacagctaggccccagctctcatgccacccctttctggtttcctgtgtgattaattatgtgaatgtgggtggccaagtcagagttttgacaagagtttgcagttcccctgctgaaaactaactccattaacagtcctttatgaaaaagacaataggagggtctgaatctgctggcttctaatgactgtaatgtaatgacaatggagagagagggagggaaggaggaggagaagttgggggagcctggacctaagataatgggtgagagaaaaagtagatggacaatctggtgtggtgccagcattccaggcccactcagctggcctcaggtgctcctgtccttgagaagaggaaggcaggcccatcaccatcttgatgactgaatcactcaactctgatccttctctcctcaaccgtttttctgtgttcatgtagtcattaatttacttactcattcattcaacagatatttacataaatcttatgcctgcaatataacagcaactattctggtgctgggaatacaacaaggttcctcatctctcacgttccggtgaggagagacagacaattaaaaaaacaacaaataggccaggcgcggtggctcatacctgtaatcccagcactttgggaggccgaggtgggtgtttcatgaggtcaggaatttgagaccagcctgatcaacatggtgaaaccccatgtctactaaaaatacaaaaattagccaggtgtggtggcacgtgcctgtaatctcagctactcaggaggctgaggcaggagaattgcttgaacccaggaggtggaggttgcagcgagcccagattgcaccattgcactccagcctgggtgacagagtgagactccatcttaacaaacaaacaaacaaacaaacaacacaaatacatatatcgaatcagtttttgatagggtaaagtactcactagaaaataaacgtgggtaatgagataaatgatgatagataggatagagggcacttgaaatggatggtcagaagttttctgcggagctggcatttgggtttggatttaaagggcaagaaggagccagacaagccaaggtgtaagagaagagtcctccaagcagcagggaagcaagtgcaaaggtccttgcagaagcgagcttggcatattagagggacagagggaggccggagcaactggaggtgtgaacaaatgggcgagatgtgtttggaagggtgaaggccttggcaaggggtttatgtggaaatctaagtgcaactgagagccacagagagatttcagtagtggagaaccacgtgcttccatctctgactttgtgttactcatcattctagggtcttcagagactatcaagtgccaacaaggggattacccctctgcccctctaaaggattgcaagaaagaagacaccaaatccatggcattttttcccttaggaaagaagggagataatgagaagcctccacttggtattccttggagcagctggaagctaaaaaccaaatgtgggaactgtgaatcctatctctgggatatgttttctcaggaaatggaggaaatgggtgggcacgggtggcaaaatattccaggggaatacttcttcctgggccttgtggggaacaactcccaaaaggccagtggttctcagctttaagcctgtgttagaatcacctgcagggcttattaaaacacagattgccgggccttacccccagagtttgatttagtatttctgggagttggatctataatttgcatttctgaaagttcccaggtgatactgatgctcctggtcccaggaccacagacaaattctccttcttgtagcccctcattcactctgcgtaggaggcatggctcatctggctggtgggtttgggaggaggagcagaccatgctcagttagccctccccactctccctttctctctctccccatcgccctagctgcagagcatattcagacagctctccaatcagttcatcagtaataaaggtgacatgctgatcctcatctgtttttctcttgcatctgccaattgattctgcacttgagaggggaataagtatatttatttattgggtttccctcaaattccaacagagaagttggtatcagttgcaaaacaatcaactggcatccgggccacacagcagcataggaatcttggttttagcttccactaaaatatcaattatttgagggcaaaaaatgtccaattcctgggcctttaagataggaagtcaggtctgtggatggggtgaggtcaccaggatgaggtcacaaaggcattgatgcccctttgtcctatcatgtgaccacttgtcacacttccatcaaacagtacctgccccttaggtgtgctagggaataaatgaaatgcctgggacatcatcgttaagtggcatctgatgcataagcagtgccctaggaatggggttgcctgccttggtctctaaaggatgggttcaaaaggcaagagcagcacacaagaagatagcttcaagcaggagataaagcttggcccagggcccaaaggggatacgacccttcaggttggccctgacctctgggttggattaccagtgacacaatgaacatttcattatgaggccatcccttgaggtagttgcattgcaacagctctccctacccagtgctgcatttccaatgctttctctgttcaggctgctgggtgacatttctatgtctccccttcaacggtgaaatatttcagtggttgtccatcacctatgggagtctgacatggcataatcaggccactggggcattgctagttgtgctgtccctgatattcaccgtggtaggcagtttctgaaatggctcccagtgatctccaactcctgaaattcacactctgtgtaatcccctccctttgagtgtgggctagacctggtggccaaagtgataggatttcacttctgatgttaggctatgaaaggctgtgaccgctctctctgcctcttctctctcacttgaagcaaactgacatgctgaaagctgccctatggagaggctcatgtggcaaggaacagagggtggcttctggccaacacccagtgaggaactcaggccctcagtcaaacagcctgcaaggaactgaaccctgccaataaccgtaagtaagcctggaagtggatcactcccctttgagatgcctgcagccccagtggacacctttactgcagccttgtgacggactcagctaaactgtacctgattcttgacccatagaaactaataggtgtttcatggcactaaggcttcagataatttgttacaaactgaaatgatgagtacagattttggcatcaagagaaggatagtatcatgacatatacctaaaaatgtgagatagctttggaaccaggcagtgggcagaggtgagaagtattctgagaagcttgttagagaaatcttcaattgcctcaaagacaattgaagacactgtagaaatctggactttgaggatacagctggtgggggcttaaaagaagtgatgaacatgttattggaaactagaatgtctttgtccattttctattgcctgtaacagaatatctaaagctgggtaatttgtaaagaaaagaaatttatttgacagttaccagttacagaggctgaggagtccaaggtcaaagggctgcatctggtgagagccttcttattggtgaggactgtctgcagagaggactgagcatgttgatgtgcctgctcaggtctctcttcttttgttttgtttttgagatggagtctcgctctgttgcccaggctggagtgtagtagcgtgatctcggctcactacagccctcacctcctgggttcaagtgattctcctgtctcagcctcacaagtagctgggactacaggtgtgtgccaccacatctggctaattttcgtatttttcatagagatggggtttcaccgtgtttgccaggctgggctcgaactcctgatccacctgcctcagcctcccaaagtgctgggattacggcacgagccatcatgcctggcctcttcctgttcttataaagccaccagtcccactcttgtgataacccattaatccatggatggattaacccattcatgaagacagggttctcatgatccaatcacctctttaagtccccacctttcaacactaccatattggggattaactttccagcacatgacatttgggggacccatgcaaaccatatcatggaggagggacatccttgttaggtagtggtagaaagcttagtgccactattgtctgcagttacatggaaagcaaaatatgtacctaataaacttagtgatctagctatggagatgtccaagcaaagtgttgaaaataatttcttcttactgcttatgtgagaagagagaaaaaaaaaagttaaagtgagacaggacctgatagttttgaaaattctcagtctcccaagtcagcaaaaggtgctaaaattaagaaatggcatttgagcaagaaatggtggtctgagataaagctgtgggtgtgactgtgggcctttggttaagacttcagaaagatcaaaagatcatggtattattcagtcatacaaaggccctttaaagagattagggtaggcctcatagatcctccagatcaaacaatagggactctaggaagccaaggggctgtcccttggccatcttttcaagaggctcaggttgaaaagtttagttctcaaagaaatttgtgggtttgtttttttgtgtaatagagggaatctcagtgcaatttacagaagacccagaaggtttctgagaaaacctatgagaagaaacacagctgggacagaaaggaacagagacagtacaaaataaaatgaggccattggacccctaaaattctcagcaggaaacaggctgagaaaacaagtcagctttaaacacaggtttcctttcatgaaaaaggaaggattactcagagggaagaaccaagagcttagaaggtggagctaagagtcatggagaattatccccaggctttgaaacctaaccaagaaacttgcagtcttttcctggctggatttcaaaattgttacggaccagtgacgcctttgttcctcacattttcctccctttgagtagcagtgtttatagccattcctctatacctaacctgccattgtatgttgggcatatggggggcagataatttatctccttagcttttcaaatcaccaaatctgtagtaacagtattctagaacttgtacttaaggaattatacccaagagcctcatccacacctgcacctgatttagatgatgagatcctggactttcagttggtgctcccacgggaggagatgttagagaccttgggaaggatgattgcattttgtgtgtggaagggacatgtattctgcatgtggaagggacaagaatcattggagagccagagggtagattgtgataggcagcttcagaaatgactctaaatttctttctcttctggtattcatgtccttgtgcagtcccctccctttgtgtgtgggctggacctagtgatttgcttctaaagaatagaatacagaaaaagtgatagaatgtcacttctcatatcaggttataaaagactgtcacttctgtcttatcctctctctctggctctactctctggcttgctctgatgaagcagctgggttgaaagcttccctttggagaagaactgagggctgtctctggtcaatagcactgaggaactgaatccagcaaacaattatgtgaagaaacttggaagcttgtcctcccctctagttgagctttgagatgactgccgccctagtggacaccttgattgaagccttatgagaaaccctaagccagagaacccaattaagctacgcttacattcctaacacagagaaaatatgagctaataaatgttgtttcaaaccactaagctttggagtaatatgtgacacagcaacagacacctaacgcacctgccctaaggtcgggctacactgcattttccccagaaacattacactctctcctccccagggcctttgcacatacttctcatctctcctaccttttaggtctggtagacttcaacctgttctacagacttaggtcaggtatcccttcctctaggaagctgtctttgatgctccaactcccttgtgtgttcccataatagcttatgtaagttcatacaatgccatcccaatgcacagcacattatagcaactgtttgtcccctcaactggtagagaagggaagggatcttgccttattcatcacagtgctctaaaatttaacacaatgcgtcacatggagtagaatgataatagcacacttttattgaatgcctacatcatacctggtaagaaataattcattgcaggatttgggcttgtgttagatgatttgggtactgtttgaagccatttaatgcaattattttacttaagaaaaacattcaatgagagcggtactttaaacaccccattttacagacaacttgaacagcaggttaggtgctcagttcatgtttgatggaaaatgaacaattgaatcatgagaagcatgttttttcttctgtcctgtgtctcccttctctcaagaactctttgcaaataccagagtatttgtattttgtgtgtggaagggacatgtattttgcatgtgggccagaaggcctcctgggcatctggacatccactttgtgcttgactggtcatgttacctagcttggtatttccagataagtacctggatctatccctgggtgtctcaaagggagggcttggttagcacccagagagtttgatgggcaccagaaaccacacctccagctcttcgcccacagctgtgcctctggctcccagacagaatcagcattttcctctccccacactctgtcattataaaccacgtaaattcctcgatacccatgttacaacgaacagatgcggctctgtatttttaatgtattatctctaattagcagcagtgggcatggaagaactctgtggtccctggggctgtccctcactgatgcagctgcgagtacatttgtgatgaagaatctggccaggctcctctggcccgcacagccctggcaagtgggtgagggaacttccatgtgcaaagtatctactctgccaggaagtgggaaagggccgccaaggcctgatcatcagtccactgctcatctagcccccactcccacccctctatgctgtctaaataccctgagaggatgtccttcattgggatcccagagacagggcagacaacagcctccaatgtcatgggcaaaacagatttttctaggtttgaggtctgcagtgtgaagatctgtgaaatgcaaaaagagaatgcttcagtgcccagggcaaacataaggggcgggggaactgcatggacttcagaaaagaagggggctggttagtgagagcaaatgtatgctccttagctctgtccaaagaggaagggtatttcttataataaatgtcatgctcatgactgacatgttttgggcgtttactatggactaagccctatttctaagtgttctccagatatcatcacgtataattctagaggcagtgtcagcccccggccaatgaccaccatggacctccctgtagttgaacaaagttgggtttgctgactggtggcagtgagggagaatgcacaccacagggagctgtgcagtgtctcagtaagaaggtaagaaataattcactgtaggattcgggcttgtgttagttaattgggggagggttcaaggaagcagagctttgccctggattggagactggaggtaggtgtaattctctggttgggtacttcataaattttatttacaaggcaggaggaatgaaggaagataagagttgtaattggtaaagaagcagccatcactcacatcagccaagaggtggagggaggggggctgttaagtcatctttgtattttgaataatgttcttgtttttgtctgaattcatgatgttgaaatggtcttgtttttgtcttcatctatcagggtcctagagtggttttgtccggcattgacattcagtgaaattgtttatggtcaacaggagaaccccaaggtctaggtgtaggtgccaggccagctctcggcagcaaaaggccttactgatagtgccaggccagcttgcagccatcaggggctgctgttctccttctcagcaggccctgttactatgccagtttacagaaataaagaaattgaggcaaagacagattgcctggtcttagttgtctcacagctgggaagcagcagagattccagagtccctgaaagtcaagtgagcatcaagagacaacagagggaactaaaggggagagtttgtaattacgggaagccagcctgaccatgaggggaactggtcaagagatagaacacaggatttgtagtcagagatctctaccttgggaatctgtcattgctacttactagccatgtggccctgggcaatttgtcgaacatgagaaattcactttattcttatgtataatggcaacaccaaaagctgtttctcagggtcatatgggaatagaatgagaagacatggcataaagaacttacgtaccacttgggacacagatgctgccctgagtatttactgaacgccaggcactgttctaagtccctcgcatgtatttactcatctattacagcaaccctttataacctgtggcttgcaggtgagaagatggagacacagagaggttaggcgacttgcttgaggtcacacagctatcaagtagcagaactcaggcatcctggctgcagcacccacactctaccatgtgtcatagtagctgtggggtcattgctccttgtccactctaagtgctccagatcatgagcttcaagaccctagtcttattctgatggtgatttaatgccctggaactctcaaggccccagacttttgcttgtgaatgggtctaagctgcttgcttggctctggtccggagagcattcatttccttttagaaggtcaaaacattcttggcatgacagataatatagattcaggttgctgcagtctatagatcaaataaaacatagtattgccttattagtatttctacacctttcagtaagtagtagagtcagagaaaaccctgaaaaatgagtataaactaaagagggtaggagaatgactcaatgctgcagcacaagccctcttttggcaagatcgatgtgtgggcagaaggcaaatggctgctgagaggaaatgggccacacctggctggtcttattctatcctgtaatggcagaaagctgttcaggatggctatggcgcacagcccagggctgactcagcattgcctcttcctaacctgttgagtgggtttatagattgtgtcacaagttctgggaaaatgagaggtcaggattcctgggcccaatggctcgttaacagaggtcctgtgtgccatcaccccctccagtccttgtcccactggacttgtcccccttgtcgcactgggggagatgagggcctggaactcacagcaaaattctctctgtggcttgatgcaatcccagatcctcaccatcaacctttgtgaggctcatctgttcttaattatatctctaaatcccgaggcattacaactctgagaatttgggaaatttagctgcttagaggattcataataatcacaaaatccctggtatttacagagctcccttttgcagactgtgaaaggcagacaagacaatactgtagtggtaaaggcaccccgaaattgctctcaagttctcttcactgaatgccaggcccttagtctgtattattttgtgtagctcaagggggcaaattgaaaagaatacttttccctattactttctgagagagaccacagagaagagagagatgttaagttaatgtcgaagatatgcccagggttgctgccaagcccctgccctcttttcaggattgcgctgctgaagggaggggctcctgcagctatactggtacaagctgagcttgcccctttctagctgcagctgattggacaaggagtggagacactcgactgatgagtggagccaatcagattctctctcttgatagtttgaattaagagatgtggaaactgggagttgggttcctggatttgaaggtcaggcagactcaggggctggagtgaccatttgggaccaagcagagagaaggggaatagaccatgtaatatctgagagttgcttttcagcactttctgcccatgtatttgttcagcaaattctctgattcctaagccaggagccatcccgtgaggccgttactgcaaacaagctgaaaatcctgctttgtttcttttggacacaacatgctttccttcagcttcagtagacgatgaggccagcaccacatgggctagatgtacatgagatgtgagcaaccacacttcccctctgacggggacagacagcatcacaggtgagtgggagacccacatgtggtccattccagacacccccgctgcttttattagaagccaacatgggcctcccttgagctgccaggtgttgggtgcagctgcccctcacctccctagcttacaggagaaggactgagcaaagtctcttcaaaggagccattattgtgacacagcacagccatctgctccccgcattgatctgacagtggcagcaagggctgaaagcagtagtagaggcccaggagcacaattcagtgaacagccctcattgatctgtttacctgcttgatggctggccaaactctctgtgtccgaaagacacccttggaaggtcagagctggaaggacaccttagggaggcctgaggacagtccaagattgtcacaaatgggaaaagcaagccctaaagatactattgagatatgacctttccaatttcaatcaagggaactcagataactcccactgtttatgggacagccctggggagggggacagggtgctattgtgctttgtagtcctatttgccacaggtagtaaagcaaagagaatatctatttatatgaatccataggactgaatcataagctcttgaacgaaaagaaaaagcacattcttcttaccgcggtaacaatgtgtggtcactagttcagaactcccactgtccctaagccacaggatgcagaccaacacaatcaaagagttctctcggctggaggttccaactggaatgtgtgagttggtggcttctatggtgccagcttttgcttagcctttgcttggtcacatattcagggtcaacctgccctgtcccagtgacaattgtctccagcaggaaattcattatgagccccttttccacttgtcgagtagattctggaaatagtctgctgtcctccccaccacctcccactaagatcccaggagccagggatttagtccctggaatccctgcagccttgatcattaaccactccacttaagtgtggcccatctgtctggttggtctgcttcaatctctggtcccatttcttgctcccccatgggctagcagttttgtgaaactgtttctggatggatggactttgggcctactctcccaagggttgggatttatcttccccatatctattaacccacaaatgtccctgacctgaaagtcacacaaatacctgagtcatgtgaccacctcattcccttagactttgccttcccaaaaatgccagtcctgatgagggtaggagattttgtcttacaatattgggtggctgatagcaagcattggtgtctctcccccattcctgctctaaccaccaccactataatcatgagcattggttttagatgaagaaagaactggctttgaatgctgttcccactactaactgtatgaacttggcaagttagcaaaccacattcttctgatcctccttcttcttgtccgtgtaaagggtgaattaaaacctactcaaggtgacaggtgtagagcaaatgagagaacaaatgagagcatgaatataaagaatttagcatagcgcatcacacctgatactaatatgtaacactcattgagagtttataatatgttaagttctatgcaaagtgctttgtaaacattaccttatttaatctgcacagtaatctagtaagatcctattatccaaaattttaaaatgaaaaacctgaagcttgaaaggttaagtaaattgctcaaagttaacagctagtcagtggatgagcaaacactgattgtgacctcatggagaccaaaaatgatgatttatctaatttaatgtcattgtataatgcctattatataccaggcaccccaaaaatgtatgctgaatgagtgtatggctcccaagtcagtgcccctttgcatagctgggttgagagctcagctctgccaacttactgcttctctctctctctctttttgagggaggacataaagctgtttttatttctgccagcatttgtgttcttatccctagtatggctattactggatcttttaatacattcaaactttctatctgaatggatacatttccataccacctactctttaatcagagattaagagatcttaactcacagattcagcacttggacagagctaggatttttgagctaatgtgtagtcggtatgggatttgcatttaaaaactatttacattaaagtgtgacccacatatgagaaaagactgcgctcttcacttacagctcagtggttttggctctctctttcttctcatagtctatgagatgagaaaagatttccataaagattttatgagtccaagagaaacattactcaaacaggatttatttcaaaggcatcattcttgtggcatgctgtttaaaggggaagcaaagctcatattggtacaattcttatactcaaagaaagtacaaattttgcagaatatcctcttaagacctaccaaggggacaacttcttcaatttggttcaaattagcaaaatataaagcattttcagcatctctgggctcatacttgaaaccagtgataagtgacaataagaatatgattttcccccattcaccctgaaacaaggagaaaggtaattactgtattgttatttttggaccttcatgctctgggacaaaaatatatttatgatgcccaggcactgtgctaaacaccacaaggcaaacaaggcacattttctgctcttaatgacctcgctggtagggaagagacatgtacccataagcaacacattacgcagggagaaaagagttatgagagaaatagatacaagctgggaactcattctggagttctgtcagggcatttattgtctttctgtctagtggacaaactcctattcattttcctgcaaccctcctctgtgaatcctttcctgatcctctgagacagtcagtcttccctccttggggttcccacaaatgttgaagaaaagtaaaatgagaataacagctactaaataagtaattattaagtatataaaaactgttctgtaggagaaaggggcaggaaataattaactgtcaaggaagaagtggagatgcctgaattagttcttgaaaaatgtggggaaggtcgttttggctagggaaagcaggaagcatgaaggcatggcagcatggcagtatgcatagttatggtgtgtttacagaatgccaagcagcgtggggtagttaaagcaaggtgcaagggagggaatggtgtggggaactgaagatgatggggaggaagtgacagaaaatgaaggagctgagttgggatggagtcggattataaaatcttctgttagaaaatttgttcctaatcctgtaggtggtgggagctttcaaaatatattttaacttttacttgtttttctgtgtgcagaaagtaatataagcttattataaaacttagaaatacaaaagaacataaataataaaatgcattagtactgtgtatttaaactacatattcagttttgtatattaattttttaacttaatatcctatattaagcattttcaaatttattcgaaagtttctgaaattataattttaatccccatgtgttgtatcagccacaggtgccagtttatggaaccattaatattggacatatactgtttccttttccccattataataaataatgctgcagtgaacatccttgcacatatcattttgcaccagcctctcactattccctagttccttggtataaatccctaaaagtggtatccacatttcacgttttaattcctaccatgaaaattaccttccaaaaaagttgtgccatttataatcccaccaacaggacatgaagttctaagaggttcagtgacttgtctaagattaaacagctatgaatggagaactggaggcaaatgtgagtactggtatccacggggctatggcagaacttcagtggggagatgggagtggggtggccagaggtaattgagtctggaggactgaaagtgacttaggtgaagactgatggtctaatgagacagcttcaaaggacaggctgtcaatggacaacatttgtaatttcatactttctctaaagctgcctatgtcacgactcttcccacttgagaatgttcagaccaaagagaaatgaaacatatctacctttctattgactgttaatcctttgtagaatagggcattaggctggcattagtgataagggcacatgtgaaaacttgcctgtttctctaaaatttggttcaaggaggattccccattaatgccatgagttcactgcagaggtcaacactgggcatacacttcaatcatccataaagaaaaatggaggtacctatctctttgaggtcacagcatgctttctcagttgtttcctagttaagaaattactcaataaagaatggaagattcaggatccatagttttctcaatcctcataccctgaatttactagctaacttccccctttcctttcttccttccattcttccttctttccttcccttctcttcctccttttcttcccttcgtggctacggatgcagtctagagccaacaggagcaccaaattcaggcaatcaagttatcaaagctccatatcttactcatcacaggcttgaaagggattcagagtcatgtactccagcctacttcataaattctctctaccacaccagctggaggctggtgtttgtccagcccctccttgactcttccaatggtctccccaaggaagctattccattttattacaaagatctttgcactgagtcaaggtttgactcctgcaactacccattggttcagtttctcccagttatttaaactttcttccatagaatggacatttagctacccaaaaacaggggccattttcctctcagtaggtgatatattggtatatgtcttaggctgcggagtaaaaaagacctgggcttccaattttgaatctgccagcaaccagctgtgtgtagttgggcaagttgctaaatatctccgagcctcagatgatttcctctagaataaatgatgacacatttacctcacctcatttagtaaggactaaatgaaatgtcaatagtagggcaaattgtggatggttgttagatgttaggtcccctcacagttgccttttttttttaagtcagtatttctccaaggtggtctctgactagttgtatcgagatagcctagggtgagtattgaaaatgtagatttccggatcaactcctaatcaaccgagttatagtctgtgagtgtgaaatctagacactttcatttgtttagttcagagaagtatccatggagccaagaagttagaaggccttaacacatatgggaactctccaagccttctcagggagtctacagtcaaagacccatatgatccctgggacacatgccttgaattgggaaacaaggccccactttcaagatgtttcttttgcccactctcagatagaagccttccctcttattatggaatttggacttggaagagattggcaatggccaatgaagaccagggctcttcaatataacttagaaggagttagaaggagagggtcagccctagaaggaggatgagctgggcagggcggggctggggttcatgggccagtgcaacagactggaattcagtggactctctaggccaggcaggaagctagagggcctcccatgaccatagcagacacacagtggacacacagtggaattcccagggctttccctgacatgctggatgtcagcgcaatcaactccatgcccaccctctctagtggatgagtctaggctcccaggaagtcctaatactctaatttattctgcttgtcctcttgtcctctcatcctccctttttccctgttgtgtccccgttgtaagctctctcctcacacctaagctgatggctcccagacatctattttcaacctttactcctccccaaaactttagatccttacatccttctacctctggcatcccaggggcacctcaaacttaagatgccatcaccccaggggcacctcaaacttaagatgatcaccccctttgccacttcctgccatcccacacactggccactcaaaccaagggctgacagccatcttattcctcctcccgctttgtccctcaggttaattgcattgctaaccaaatgatgctgtttttaagtctgttaaacctctccctcctctcagtctccactaatactgtctgtgttaattcaggcctcatcatctctcacctgggcaactgcaacaatgagcagtttgtgtctgtgcctgcatccatccttccatcctgtactccagcagcagccagggtggtctttcaaaaatgcaaagctgataatgttactcccctgctgtaaaccttccagcggtttcctattgccttcagaataaaatacgaatcatctggcctccatctatctctccaggctcatcctctctcaattttccatatccttcaggtactttcccaggcatagaagctaagaattccccctttgtccagagccctaggctgaccaagccccactgaagaccatgctttctgatttctgcctctgtcatttccttattgtccctgctcccaatccagctcactgtccaattcagcatggacaggagagacatggaaagaaaaacaactgttataattattgccaaaagctgtgttctgttactatgcattgtgcatagtaagagttcacattaaattcctcattttaattctcacagtatcctgttgggacagacagatgaagaaccagagaccagagagtttaagtagcttgccaaaggtcacacagcagtgtaagcagtacgggtgattcttaagcccacattgtttgacttccgagacatatcagaaaactacgtcaaagaacacgcacaactcagacctatttccagtggcctatgcagaagagctaccctgcttgaatggaaaccccttaagatacactattctcaaaaacctaagtgcttagcctggcttatggaggaggcaatgcaatctaccacaagatgattaagacaacaatgaacttaagacccagccactgctggagaatatctgcctgtgaattcaatttggttcaattcaatccgatttaattcagtgcagttattgagtgcccaccacataccccatagggctggtccagagagaaacgcaggggtccctcctgggaaattataactaacccaagcatgggcaccacatgaggaagcaggaatgggggttctgggatctggggttcaaggcaggaatcttgtggtcagccctggagcacttaggagaagaatctgccaaattcctatgccagtgtctggttggcagcaagctctataatttttaagtagtatgaattctgtgcccatatttcttacaaaatatgtgtatggagaaagataccaccagtttagtctaataggtattctcaggcctaatatatatgaaagaaattgggactggtgagtggttaagagcatgggcttgggagacaaagtcttggctctattacttcctagctgagccatcttgggcaggctaggttaactttctgggctcaatttcctcatgtgtcaaaggggaatgaaaataataccagcctcatagggttattaaaagggttaagacagattatgcatatcgagtgcttagcctggccccaaagtgcctagaaagggtgcaaaaagtgttagtgaatacaattcttatggtcgctgatacttaataaatgtctcctgaataaaagaatgcatgagtggaatgtacaacttaggagagacagatagctagaggatactggatgctgagctaaggctctggactatattccatgggtgacaggagccatcaaagagttttcagcaaggaaacagcacagccagatttggtttagaaaggtcacactggaccagaatagaggatgggcaggagggagaaattctggagacaagcaggaggctgcttcagtgttccaggtgtgagagcacctaaacaaagtcgggcgtactggtgttgcagagaaagggaaaaattggaaagatacttaggaggcagaactggcaggacttggcaaccaagagatgggagcagatgacaaccaccctgctctgtgcaatgtcagaaaagaagaatccagttagggaatcaggggagaagctgatggcctctctggaagcccccagccactgttttcaccgggaatgctgagtgctgcttgttcctctgccccagcacagagcagaggttcatgtgtggcctgcacacagcgtggggcacagtgggcagccgatgggaaattcttctgcataacagatctcagagcttacaactggggccagcagccagccgcaggaaagggtttccccttggcagacaggcctcggctaagggacagaagtcattcctaattgcagcatgtttttcaggggaagtctccaaagctgtttagaaaataaaacctctgaaaacagtccaaataaagggaaagtgactcccatttgtttagagctactttgtgctgagtgccatcactagtttgttctcactcagccttcagcatgactgaagaagaattagctgcacattttacagagggggacactgagactcagaggtttttttttttaaatttatttaaatacgaccatttttcagtggaggaatcagaattcaaacccatctctttgactccaaagtccgttctctttcttctatgacatattttataatccttaattttaaaaggtctgtttcctcggacattcacatactgtggcagtgtaaaatgatcaaatgcttttagaaaacaatttggcaataagaatcaagtatcttaaaaaatattcattctgggaattgctcctaaagaaataatcataaattcagaaaaaaaaaagctttgcacacaaaaatgttccttgcagcaatatttataacataaacaacgaggaacagcctaaatgttcacagaaagaggaatggttaagtaagctgtgatatatccacttaatgaatattttgaggtcaagggtttataataacagagaaaatgctaatgttataagtgcagaataatcaggatacaaaattgtacttagcctcatcaagcgatggtgttacagaaccactgggtttccatttagagaactttcctctccaacctctatcagctccttccaaatcactccagagtttttaaaaaataacactacttaataagaaaaacacataatttcttaatgttatataatgggagaaaaaactctagaactaattttgctgtttttattgatctgtaatatagaatttagtaaaagctatgcttgcctttaagtccctcttattcagaaattctagagctgccaaacctatcactcctctttaatataataattctggaggcagtagtcatataagaagccaaaaaaaaagcatccatgtgggaaagaagaaataaaattacattacttgcagctaatatgattgtctaatctagaaaatctaaaataatcaactttaaaactattagggctgatgagagagttcagtaagatggctggttacagaagaaatgtacagaaatcaatagctttcttatttaccagcaataagcaactagaaaaaaaatgcagtgacaaatggccctattcactataacaataaaaactataaaaggacctaggaaaaaaacctaacaagaaattcactagacttatgtgatgaaaactataaaattttattcaagatcattaaaaaaggcctggaaaataagaggcataccatcgtccaggataggaatatttactgtaaaaattttaattctctccaaatcaatctacaaattcagtgaaatttcaacgaaagtcacagtgaaatttctttgggggaaatctgaaaaatttactctaaaattcatctggaaaagtaaacgcacaacaattgtcaacaaatattttcaaagtaataataatgaaggaggtcttttctgggtagaaaacaaaaattattacaaagctatggcaaaattcaaatgatacaattatgacacagaaatagattaacagagaaataaaatagaagaaaaagtccagttgtagaaccatgaatagagctgaactcagtttatgatgaaaggactatttcaaatcagaaaggacaggtttggagttaattcattattcatttataactaaaataaagctagatctatagctcaaacctcgtacaaaaatataattcacacagattaaatagctaaatgtaaaatataaaaattctgagagttccagaataaatagagaagactatttctataatttccaagcaggaaggtattcctaaccaagacacaaaactgagaagttttatgtgatcaaatcaggagatcaactgatttttgttgttgttgttgttgttgttgttgttgagatggagtctccctctgtcgcccaggctggagtgcagtggcgcaatatcggctcactgcaagctccgcctcccaggtacatgccattctcctgcctcagcctccctagtagctgggactataggcgcccgccaccacgcccggctaattttgttttgtatttttagtagagacggagtttcaccatgttagccaggacagtctccatctcctgaccttgtgatccgcccaccttagcctcccaaagtgctgggattacaggcgtgagccactgcgcccggccaagatcaactgatttcaacacacacacacaaaataaaacttatgctgtgagagacaacaaagtaaggctaaaagacatgctactgattgataaaacctttttacaacatatattgattttaatacatgttaaaaatatacaaagagctcctataaatgaataggaaaaacaaacatgacctgatagaaaaatgggtagagaatatgaacaggcaatccagaaaataaaagtgaccatggacatatgaagagattactaactacactaataattggaggaatgtttttcacccactgagatggataaaaacaaaactttaatttggaaaagagttagggaaatagccactgttatacatggttgatggaaacatgaaattggcacagtctttctggagtacactttagcagagtctaaatttaaaaataatgtatactttgacccagaaattctattttaaagaaagctatcctattaatgctccaatgtgcactgaggtatattcatgatgatgttaactataacattatttgaaatagtgaaaaatgcaattattagggaaattgttaaaaaaaatgaggctgacatatatatatatactgacattgaaacatatttaacgtagacatttaagagaataaaagcaagctgtagaataatatgtttatgtttcacctcctatcctgtgtgtgtgtgtgtgtgtgtgtgtgtgtgtgcatgcgccagcgtgtgtgtgtgtaatgcctaggctaatagaccaacttaataatgcttagggaagacagtggaattagggtagggatttaacacatagacgactttaacgttttattctgtactctcaggtatgctttgaatttttcacaaagagtataaattactcataataaaaagtgggtatatacttaaacacatacacacacactcacacaatactctatgaacacagctctttaaaaacaaagccatacctataaaaaaaagagaaagaaatgaatcaaaatgttcatgcatagagtttctttattcagtttttctcaattttctaaattttctttaatgaccatgctttatgtttacaatggaaataaaaaatataatactcgtctgcttttgtggggatctaaatatatataaaagaatatacatattctttttctttcttttttttttttttttgagatggagtctggctctgtcacccaggctggagtgcagtggagcgatcgttgctcactgcaagctccgcctcccgggtgcacaccattctcctgcctcagcctcccaagtagctgggagtaaaggcgtctgccaccacgcctggctaattttttgtatttttagtagagacggggtttcaccatgttagccaggatggtctcgatctcctgaccttgtgatctgcctgccttggcctcccaaagtgctgggattacaggcatgagacaccgtgccctgcctattcttttaaaattaaatttttttttgtgggctctttttttcagcccgcatcgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataacgctgcatatctacaactatctgatttttgacaaacctgagaaaaacaagcaatggggaaaggattccctatttaataaatggtactgggaaaactggctagccatatgcagaaagctgaaactggatcccttccttacaccttatacaaaaattaattcaagatggattaaagacttaaataaacgttagacctaaaaccataaaaaccctagaagaaaacctaggcattatcattcaggacataggcatgggcaaagacttcatgtctaaaacaccaaaagcaatggcaacaaaagccagaattgacaaatgggatctaattaaactaaagagcttctgcacagcaaaagaaactaccatcagagtgaacagcaacctaaaaaacgggagaaaatttttgcaacctactcatctgacaaagggctaatatccagaatctacaatgaactcaaacaaatttacaagaaaaaaaaaacaaccccatcaaaaagtgggcgaaggacatgaacagacatttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtggaagtcagtgtggcgattcctcagggatctagaactagaaataccatttgacccagccatctcattactgggtatatacccaaaggattaaaaatcatgctgctataaagacacatgcacacgtatgtttattgcggcattattcacaatagcaaagacttggaaccaacccaagtgtccaacaatgatagagtggattaagaaaatgtggcacatatacaccatggaatactatgcagccataaaaaatgaagagttcatgtcctttgtagggacatggatgaaattggaaatcatcattcccagtaaactatcgcaaggacaaaaaaccaaacactgcatgttctcactcataggtggaaattgaacactgagaacacatggacacaggaaggggaacatcacactctggggactgttgtggggtggggggaggggggagggatagcattaggagatatacctaatgctaaatgacgagttaatgggtgcagcacactagcatggcgcatgtatacatatgtaactaacctgcacattgtgcacatgtaccctaaaacttaaagtaaaataataataataataataataaaaagaaaaccctaaagacaccatcaaaaaaaaaatggaaatttattttttgtcacaaatatgtatatttgtgacaactatagtatatacactagtgagtttttcaataaaatataatttgcatttaaagtcatttagcttttggcaaactggaggacaccatgtcagacatatttaatttcatatggggggatattttaaattgaaaataaaaataggattaaaaattttaatcttaaaaaaaattattgatttatttttcatttcaatagtttttgggtgtacaggtggtttttggttacatggacatgttctttagtggtgatttctgagattttagtccacccatcacctgagcagtgtatactgtacccaatatgtagtcttttacccctcaaccccctctcaatcttctcctccaagtccccaaagtccattatatcactcttatgcctttgcaccctcatagcttagctcccacttataagtgagaacatacggcatttggttttccactcctgagctactcctcttagaataatggcctccagctccatccaagttgctgcaaaagacactatttcattcctttttatggctgagtagtattccatggggtacatataccacgttttctttatccactcattggttgatgggcacttaggttggtttcttatttttgcaattgcaaattgtgctactaatactctctattcttttaaagttctgcttactttttgctgtaagcaaattcagtaaaataatttctctttccctctgagtctggttgggtgactttgaagcagaaagtgaggctgggcatccctgggccctcagcaccaacttgagtgcattcgtaggaggtgaatgaccaaatgcagacaggctcaagagcaaacaggtctggtgaaagggttcatgttatcctatcaaaaatgattaatgggatttcctagcataatagtatctgtataataaattgatgatgcttgattatgactgtgaatggatcatcatgctttgcatccatccaattcccacatcactagaaacatctgggtcacagctctgcctggtacaatctgaatggaagaggaggggaaagaaattaaaacagaaagggagctaaaattacttataagaaaggagggggagtggctatcattgagtacttgctctgtgctacttacctcgtaagcacaatttttggcactattctatctattttgcagctaggagcactgaaagattagtcacttgcctaagattgcccagtggaacttggtttatctgagtccagatcctggcctcttcccatgggccttccaggcagaggataggagaggggaaaggatggggaagtgaagcacaaagcagctttcacctacatagagaagaatgtatctgaactctgagcccttttcttcctccccaggctgagctctgaaacttctcctggcagttcaagagagcgatggagggaatgctggggcacatctaaataaagcctccaagtgggagttcctgctcagctatgcatgagctctttgtgacttcatctcccagcctacaacttgtgaaataagcacgacttcactcagagcacagccagaaacatacaaactttccaaaaatatttgaatgttgacagcagactgtcttgcattccagtgaataattggtttgtatgagtgtgtgtgtgacctaaatccacagaacttaccattctgtggctatacaaagtaagtttcatagccctgattttccaaatctcaatggttaattgccaagctagcaggcagccatgcctttttccaggatgctggggtggctgatactggactttgaggcagtcctcttgctcactggctgcagcctgctagaagggcaggagatcaaacatatcccgatgtggggtctacagctgttgtctgacagtggtgacagggacagggggattactgttaatggggccacctggataatggattcttctttttttctgtgcctgcttgctaggaccactgcctacaccacaggtttctgtggattcactcaaatttcagtggctccccaaggctgaagggaaggtggtccttccaagggtcacttttagtgagctgggtctcactccagagctgcctaggcccccagtgttacagctctgtcagtaacactgccttttgatacacgtacacctgtagcaggtggtgccagtgtccttcctgtaatactcgatctttcagagtgggccagctgactgcaagctcccagtgtctgcatccctgtgctcgaaggcttttttcccccaatgctaggccactttgcccatgtgcacagcaggctggaagggctagggagttaataacccctcaggagcagccctcattcaatgactttcaggaattggtgtataaatacctcagctccctcattccttgggtgggataattctaagatctgggttctgcagacctgggtttcctagagtgtccctgtgggattatggcccagacccccattgtggtagctggtatgaccaccctttattagctacagtctcttccctgtattatgtccctcttatctgctagtgtcacctgtgcttcctaatagaacacttgtgcttgaacccttgtctcaggcctgcttttggggaacccaaacttggaaaataccctggttccagaggggcaagaactccagcatcagacacataatatgcctaggagcagccctcttctgggacctctgtcttgttggggcatccgggtcactgactgggtccccatctcctgcagggcaagtctcctctcaggtatcctgtcttccacagggtcccaaatccttttcccccaagatgccccaggtacttctgtggagaagaggtgctgctttgctcctgtcaaccacatccaaccccaacatctttgagcttccacttccacatcagaaaaattgaagtaattcttgcccacctcagtcagtggccatgaggatgaatatcaataatcgctacattattgagtgttacctacatgttgtatgttagattctctgcttaatgctaatttgaaattgacaacagccctaagaaatataaattattattcctgatagcattgttttaaagctaaagaaaccgaggctcagagaggttaaatagcttccccaaatcccggagcagagctttgaatccacatctgaccttagagccctctaggcaaacagcttctcatgatacaggcacagagcacctggtgggaatgcctgcagggtgtatgggtttgtgggtcaggggtgaaagaggcagggattggccctacatgggggtactgggaaatggtctgagtccaaggaggtgtgggccaaaattggtagtagagcggatggggatgtatggtggatgaagtgacagaggtttgggaggctggaccttatattgagggaatcatgggtaagacaaaaggttagcagcagcagggccaccccacgggtggtggctggggaagcgcggcttgaggcattcatgcagagcttgagcccgccctctggagaggcagggggacttggtgcagggatatggcttaagtggccttggcagaaaggtggcaggctacactggccgccctccagaaaggctgagagggggatgccgcatctcatccgggtccctaggcatgggatgcaggctgttcccagcccccatgagtttgtggggttgtgaatattaaacaactttgcagccaggtctttctgggttatgggatgaggggtctgaagccgcagtgctcaggcatcccagggcctggtcctgagcaaccaactcccctctcaactgtagcacctgctggcaccttgacccagtccctgatgagataccgtcatctcctccaagacggaagcagtggcatctccccacgcttcccagaaccccagagtctgggaggcttgcaggtccctaaatccaagctgagttttcttttgttaagtcacaggataaagcactttacatattaatcaggttaggaatatgagagcacatatcaggggactgaaatatgtagattttgatgatgaattcatgctcatcagaaaaccaatgaatcatcctaacttcattatcaggaattatttgatgggggaattggcagagggggtaggagggtaaggaggggagtagcgagggggagaggatttcttggttctcagcacagactgtgttctcttccatcagcacatttttgcagtaggaccatttgtttctgtgacatgggtcttacacatggccacatactggaggcctcggtgaagcttgaggacatcacctggtgaggtcacaccaagattcagggcaaaccaggtagagagatataaataaccccacaagtacaactatttttaccattgttttaagattaccccagcagtccctcctgtgacactaactccctgggtgactttggcaagtcacatgccacccacctgtgcctcagtttcttcatctggcgaaggagaatgatggctgtggagcaacagggctttcaggactggaaccaagaagaggggttgaactcccaacttccaggctccctatgagctaggcacactttgaagtgtgaggatctggctgagaaggagcaaacatgggcagacactctactgactgggaggaggcatctgccattttaaataggtgattggggaaggcctcactgtgcatatgatcttaaaggtggcacctgaaataggggagggagtcagatgtgtggatatctcagggggagaggattccaagcagaggggaaagcacgtgcaaaggccctgaggtgggaagagcacgcgtggcatctaaggaccagcaaggaagccattgtggctggggaagggaataagagggagggtaggagaaggtaaggtcacagaggccgtggtggagggggcagggttacagggggcaagcctgtaaaagagggtattcaggccaaaacagtattgtggaaaggtgagaagatgaaccagaagctaaagtggctcctctatggggtaaactgaggcactgaggcacaagcaatgaggagccaggacaggcagacaggtgaggaacaccacatgaagtagggtttatgtggattcagatcctgctggagccaggtgctgctgtgaccctctcatgtgaagtctacaaacgccggctcagtgctaggtggccagcaaacattgaaggtggtggaaacagatctggatcagacatgaagagcttcgattctgccctggctctgccacatgtttgctgagtgatgctgggactcaatttcctcatctgtggaatctggcaactggacaaaacactttctgttgaactttctggaagccagattattttatttctccagggctttctttcctggggtaaacaagctgctgctgctgtctttaacaatgcaagtaaaaacctgtgggttcatactgtgtatgtccacatcatgactgaggtcaagaggtcacccctcctgcagccagcactgcttccgtggggagcaactgaggacacagccgggtgacaacagagccaggagtctcagcctcactgtactgtggaatcacccaggcactaccagggacaaaatgagctcaattcacctgagatggggagcggcaacagctcactccagggaacctcactgagcgtctttgagggaaatacaaaatgagttgattcaggtttgataaacatgtatcaagggccctccatgggcaaggtggttccacaaatgttatctccctcaattctcccagagacccgacggaggaggtatttccctcccattttgcagatgaggaaaccaaggttcagaagtcaacatggcttgtgagtgtgggtgtaaggtggtctcagtcaagaccctgggttcctagtcactttgtaatattgccccaattaaacccttatcctgatccttggagttagattgagagaggaggacattgaggttcagagaggtgaagggacttgcctaaggtcacacagacattacatggcagagatggcatttcctgccagctcatggagtcaggttgctaaaaaatgctattactatttctcttgcagtcatgataaccaaacatcccactccccaacagcccatctgagttgcggttcttgttgaagggatatcgtggagtcattgccagactccgaagagataaagcactgcaaattgaatgagaaaatctattttcacatcctgatgaagacatagctgacaatgaaagagtgaattgttttagacaaaaacacaaccccctgctttttccttttttaaaaaaacttaagagttacagctttagaaaaataggagcagctgactatcacagataaaaatgcccttttgcctaattggatctttaataaggaatcctaattaatccccctgaataaagaacttttacactggtgttatctcagcccctgtgctgatggggctggttatttccagacacagaataatgaatcttttccagccggggctaggagtcgccagagacttgtcaacttccctatgaaggtaattacttgctaaggcaccaggggaatgtggggctggggaaagggtaattacaaaaagagggactgagggcattgagggggaagcttaggagggcactgttgagccagggctgaaggaagcttggcaactgtgaaggaaaccgctggtggaaagatggaggccacgtcagcgtccaggatgtcattcccagctcagagtgaggcctgaaggacacttgccctcatgtgaaaaatgtcacttgatggagcttgacagattccaataattgtgagagccaaacagacagcaaacagaagtcaggaagcaggcctgcctgtgactcttcctggtcggtgcaaaggctgggctgtcattgcccggagacctctgtggcatccataaagacaacactaaatgaaaagggttatctggacaactcaggccacagaccagcaacgagaaggacgtgacggatgtggctaaatgacacgggccatttatctgcattgacagggctctcttgaaaggggaacgctgatggcagtctgtcccacgctcaccagggctggcatctagggagctggcaggatgtgggagccaaggcctcgatgagcctggctatctgtgaagccagcccacatcaaccaaccacagcccaaggcccaaaagcagccccagggggaagaagctgaagccaatggcataggcccagggccatctctccaggatacccaaggtctctttccaacctccaaaatccagaggggcagaaagagcagaggttgggaggcaaagggccctggcttcaggctgcaacttcctagctctgtgaccttgggtaaatgacctcactgagtctcgggttctcagagttgcttaaaggcacaaaggaaaaatcagtgtagactcctggcatgtcgttggtaccctacacatagtaattgtattttcttccttaaaaccctctcagttccagaaaaatcaccttaggaggcagatcccactggaagggaatctgtggggttggatttatatgtgaaaaattaggaggtctctgtacaccaatctgcatgttcccagcaggttacagtgagggtggtgaggacccatcacctgccttataaaactagggcaactgaagttcagaaagctaagtgacttgctgtgagagaagagtaaaagccattattgttcaaccccgactttccccatgtgcccttcagggtactgccaaatggccctgggacctcagggctgcctggcccaaggagacatgacaacctcttgctgtggcctctgcctcggtcagcctgaagctgcctccctgacttatcaactgcagaggccaagacccacaggaccttaaacctctgaaagaagctgtgtgtagctgtctgcacggagcatatgctgggaggctctgggagcagggtgagaggggcaggggaggaggggaggaaagcccttccaggtgctgtaaccatgaaagggcagaagaaggacacaagctggatttacaagctgggaatctggggctgttcaaagtcttctgtgcccaattatttcttataactgtatgaaaggccttgagagggtcagaaagttaactgaggtcacacgattagttggtagcagaattggtatttgaacccaacattgagtccaaatgctatctatgctccatggtgccctccttggtgtcaggaaagaaaatgaattagatcccagaggagcagaagagaaagaggggtagatcaggatttagagtccagatgatggggatccaatttctggctcggacacttactagctatattacatcaggtttcttaatctctttatgataatattattattttacaagagttttgtggctgggcgcaatggctcacgcctgtaatcccaacactttgggaggccatggtaggtggatcacctgaggttaggagttcaagaccagcctggccaacatggtgaaaccttgtctctactaaaaatacaaataaattagccaggtgtggtggcaggcacttgtaatcccagctactggggaggctaaggtgaggagaattgcttgaacccgggaggcagaggttgcagtgagctgagatcatgccattgcactccagcctgggcaacaagggcaaaactccatctcaaaaaaaaaaaaaagagttttgtaaacattaaatgagaccatgcatataaaaaccttagtacagtgcctgaaacatggtagctctcaaagtgattatactgttgaaggtatattaaggcaggaggaaggcagatagagactcaaagaggacagattgcatcaaagcctactttaagggtgagaaatgatcctggagtggctggcctaggatctgcagagggaacaaaatgggaaaacccagctggggagaaccacgtgtaggtgaggaggaagctaagtctctgaggctcagtttctttatctgcaagatgggtatgccaatacctaactcaaacttgggggtgaagacccaatggggcaagatggcattccacacatgtgatggcctcaattcaatcatagaggcaaacaatgaatatttgcctgtttatttatcttgacattggtcctgttgccaaagggctctgacaccaggcgaggtgagccaagtgccatatgcttttccctttgatgctggtgagatgcggttggctgtgagaaggtgctgagactctaagatctcagaggctatatttattcaacaaattgtcagaaaatctttacacctgtctgtgccaggactctactgagccctgaggattcagagatgatgggccaagtccatgctctgaaagagttcatgttgggaggaggactctgtattctagaaaagtttggcttgtgccagtgcgtcgtaggagcctggggttgcccagtgtgggtggggctgagggagggcacaggtcccaatgcatctaaaggtttcaggagggagacccttgcacaggcttataccaggtagacaaggaggtgagactagacttcaaggctaaactttagcagctccttgaaaggttgagacttcctagttcagcattgtaatcacaaagcttatcacagaaactggcacagagtaggcaaggaaaaatatttgtgaaataaataaataaagtttactaggagtcaatgtgcttcattttatggaatagatgtgcttgcccaaactcacgcataagccataaccaaacctatacgtcaaacataactggggagaaattcaataatgaatcaattcataaaaagacaaatcatttcataatgggcagaatctacttcctttatattatcactctggaaagtattctatttaggcccagggtaactcttaaacttaaatctatttcagaacacccaggaaaatggttaaaaatactgaattagttgagttctattctcaggaatccatgattttacagaggtggggctcaggaatctgcattcttccaaagagcattcaagcaagtcttctgaagcagggagttggtcagtgcaacccagtttgagaaacacaggataagtcctagagggcattttttaaaggaaacacagggtattttttttaaaagttgggggtgtaactgagatggatcagaaactgcagggctcctggaaaccgccccatctggctgcctcttcttcccttaccctgcctgacacaacatagagagatgtccctctatttccagaaagacaatcaactcctgaaaagcccattttctacttcactctttgatgtccttcataatctctttcccaaaagcctctcatgctctatcacatcatgtttctcctctttggtgcacacgaatccacagtgagctgtaaaaatcaccgatgcctgggtccctccctgggcatgctgacttatttggtctggggaatcaccttgtcaccctgctggttctaatcaggatccgagttgcatggactgcactaaaccctttatccctgcacctttttttctggcccggagattaatgtccacaaacccctcagctttcgctaagtatccccctcagccatatctccagtgaccagaagaggtatctagagaagaaagataaagccacatgcaggactggctctggaggctggaggctacagataaggcttaagaggggtccctggcggtccccaagttcactcctgagagtgggaagcctgttcatcaccctctgattgcctttcctcctgtctctctgggttttgtaggccagagacatagagcactatatggactcctggtgggacaggttgctggcaaattgatttcaccccaaccccagggtgggcaagcagacagtacccatcaaatctctcacctccttcctgccagacacagggcactgcagctcagaggaagtgagtgaatagctgaaactgacgtggctgcagaaattgacatcaagtgccagacaggcatttgcttagcaaattggctaattttaacctctgcctcacagaccaaaactctctggaaggaaagaaacaaaaagaaagtgatatttaacacatttctatttctgtgctacacagtctctctctgaggttgcaagtttgagcctaattgatttcttagtcaaaagaaaaaaaagccaaaaaggaaaaaacaaacaactgagagagatctcacattgcaatcaaacctctccagttctgttgtcgactgctgagcttttttttttttttaaagactggccaagtgacttgcataatttaagatcctttctagcactgatcagcccgctctggccaagcagtttgctgattaattattaatcagactgagtttaggatgagtaatcagcaagagtcagtgctaatttgcaaatgtcccccaggaaggttattacttaaaatacttggtggagaggctccatgttaacctttgcaattagccacaggacattgtaactggcaaggcagaagcagatctctcctccaaacaaaccaaccttggatacctactaagtgccaagatgcacattaggggcttgtcacggttctgctggcaatggcaggggaggggaagggcacagaagaaaaagaaatacgtaagtaagcaagaaaatatcaggtattgatgaatgtttaaaataaaacaagatcctctgatagacagcaagggttactttaggctgcatggacgggaaagtcttttctaaagataggaaatttacattgaactctatatttcaaaaaaacagtggtttttgttttttgtttttttaacttggaaggaagatttgaagactgtgaaggaggaggatcctaagccctgggaacagctagtgcagaagcccgagcagggaacctgcttagcccaccctagggacaggatgaagagcacagagaatgggtgtgagtgagggataggagggaagtcagacaggtaggcagtggctggacaatgtagggtcttgtaggattttattctaaatgtgatagtaagccattgggaggctttaaacaggggagacatgatttgattaataaacccaagtcactctaggtgccatctgcagaatggattacagaggggtagaagcagggagacaaggcccccgagcagcccaaaggtgctggcggaaccaaatgggcagaagcagcttcctcttaggaaaacagatgtgggaggtcgtggagaaggctaagagaacagattatgagtggggaggggatgagaagtccaaactggatggaaacaacccaaatgtccatcaacagatcaatggataaacaaaatgtggtttagacatacaagggaatattattcagccttaaaaagaaatgacggcccatctccttgtcgctactgttccattttctgcctatgaatctgactattctgggtattcttctttaatgggcatggagttccatttgggaaggcaaaaaaggtactagagatagatagtggtgttatccaccactaaatagccaatgtgcttaatgctactaagttgtacacctaaaaatggaatgataggtttttttgtttgttttgttttgttttgttttttgagatggagtcttgctctgccgcccaggctggagtgcagtggcacgatctcactgcaagctccacctcctgggttcatgccattctcctgagtagctaggactacagtcgcccaccaccatacccagctaatattttgtatttttaatagacatggggtttcaccgtgttagccaggatggtctcaatctcctgacctcatcatctgcccgcctcggcctcccaaagtgctgggattacaggcatgagccaccgtgtccagccgataggttttatgttatatatatttttccgtttttttttttaagagacagggtctccctatgttgctcaagctggtcttgaactcctgagctcaagcagtcctcccacctcagtctcctaagtagctgaaactagaggcacatgccactgtgcccagcgatatgttcattttaagattcctgttaatatgcatgaagcccagaagacccttgaggactgaaaatttaaatcaagagccactggcatctagatgatattgaaagcccatgtgtgatttgttggggctagctgggaaagagaataaaagagaggagagtcccaggaccctctgggtagtccaagcataaaggctggacagagagtggacgttggaagaaacagcaaaacagactaagaaggaatggccatagggtaaccagctacatggtttcataggagccaagagaaggaaatagttcaagaaggactggtgatcagtgtcatgtgttgccaagaggctgagtcagatgaagatggagaaacgacactggaatgggcaacctggaggttgctgtcaattttagcaaggtcagttttagtgacaaagcagggcagaaactgagaaagaactgtctcagcaattggcagtggctgagccattccgtggtagctgagtgggatggagtaataggggtttgatgggtgctgtttttattttgattttaggtggcagatattggaacatgcctttatggtgttagaagtgctcaatagagagaacaattgtggaatgcaaggaaaaggagatacatatagtagggaaattttggaggaagatgagctctggagtacaggagagggctggcctttgacaggaaccacggcatcttgtctacagaagcatgaggtgtggcagagaactcggctcaccaagcatctcatctgctcatccccgtttcctggctcccttgcagcaaagctggactgtgtgactgtttgtggccaatgaaatatgagttggaaattatgtatagcatatctgagctagagtggtggaaagccatgctggattctccactcattttccctgtcatggtattaaagaaggccacatatttcagatggtgtggttagaatatggtgcaaccccctcgagcctgggtacccacatgtgtgatgatgtggatcagagccactcccactggtccatcacaaatctgtaacatgagcaagaaggaaatctttgtggtgttataccactgagttttagggttaataaaatttaaaaaaggaagtggcaagatgtgagcctggggtggttacttaggcaagggttagatccagatgggccttgtgtgccctatcaagggattgaattttaatctgtagacaacagaagatgattgaaagcttttgcctggggcttagcatgtcagatctgcattttaattaagccattctcgtagcagtgaggaggatgaattggacagtgccaagatgctgggagatcagtaaggaggctattacatccctcaaagaagaaaagatgatgggctgaattcaggcagtggtagaaaggatggaaaggtacagtatattgggagaacttagcaattaattgaatgtggctggtgagagagagggattaaatagggatattcccagatttctggataactaggtggggaatggtaccataaactaggaaaggacacagactgatgattttatgggtcaattatgagcaaaattgagacaagttaagttggagatattggtggtccatcaaagtggagatgtccatcaggtagctggctctacagtttgactggctcagtgggtaggctgggctagggagccatatttgggaggaaataggtagtacctgaaatcttgagagcaggtaagactaccctgggagatgtgtggagtgagcagagcagtacagcaagaaggaatggacatcaaaggagacacggaaggaatggccagagagatccaagaagaatcagaaagagtggcatggaggcaagcagaaagcagagcccccagaggagaaaatgactgacagtgtaaagtaatgcagaaatgtccagaaggtgagacctgaaaaacgccttctggcattggtaattggaagtggtagtctttggaatggggtaggggtggggttggttatttgatgattatctttttttttttttttttttttgagacggagtctggctctgtcgcccaggctggagtgcagtggcgtgaactcggctcactgcaaactctgcctcctggctttgcgccattctcctgcctcagcctcccgagtagctgggaccacaggcgtctgccaccacgcccagctaatttttttttttttttgtatttttagtagagacggggtttcaccctgttagccaggatggtctcgatctcctgacctcgtgatccgcccacctcggcctcccaaggtgctgggattacaggtgagagccaccacacccggccctttgatcatcatcttaatgtgagtgatttcaggaggaggctggagggttgaagagtgggagtgaagtaggtaaggaatgaatggggagagaagacttgagggtagccagtgtagaccactcttcaagaagcttgggtgagaaattcccagggatgctagagatctacctcgtccatgaagccacctcattttgttcaaagaaactctgccttctccctccccaaatgacccaaactgttgagatccaccatatgtgaatttgaactgttgagtttcaccatatgtgaaatggtgattttgccatttcatcggactgtcattgctagttttttgtgtgaatcctgcctctctggtgagtctgtggatgtcacccatcagccactggataaagagaaactaggatgaaaagaagtacagactgggctgggcgtggtggctcacctgaggtcaggagtttgagaccaacctgaccaatatggtgaaacaccatctctcctaaaaatacaaaaattagctgggcatggtggcatgtgcctgtagtcctagctattcgggaggccgagacaagagaatcacttgaacctgggaggtggaggctgcagtgagcgagattgtgacattgcactccagcctggctgacagagcaagactccatctcaaaaaaaaaaaaaaaaaaaaaagaaaagtaaaaaagaaaaaagtacagactaagggatagaactgaagacttaagtcagtcttgggaacctgggaagtggttgcagtagcaggagagacgcaaaccaacgtgaaacaacatgtaggttaagctgagagtgagtggaacaaacattcatggccaaacatgaaaacagagaccaggagggggccttgaacattcagaatgaagcaacatcattccagaagacaggtcttgccagaacaaggggctctggaggacccagaacaactccttccatctgtcttagcggcaccatcaggcatctggcagctcctcaagagaggtcgaggacagcattttgttctctggtgcccttcacagtcctggcacaggccgcctcgcagatgaggcacttagtacaaacctgttgcatgcagtcagacccatggggggcaggccagctgcccgacctcagcttcccatgcacagaactttgccaagtcacaagctttagcagagccgctgtgcccactgcgacaacaccagttcacttcctgctcctcccagctgtgacttttgttctctttttgagagcaagttctcactagtggaagcaaggaagtcacattgatactccatgtagagtgctggagccctggccttcactcctccggacacatttgtgccagcagcatgctaaggcactaatcttttcttactgctccgcggcagagcttgtaatgctatttccaactccaagagatacaggagacgagattttaaagggctggttatttatggcttggctcctgatggatacagcagatgcaatttcatgggctccatcaaaaaaggacagttacttagtgtgacttaaagagttgtgatgtgtcaaggaaggagagagaagcaaaggcgtcacaagcccacaggaaggcaggaggtctgaggctcggttagaatgggccttattcgcttaccagctcagccaacatgggttcagcatccttagtcatgcaccatctgagctgttttctgagtgtctctgctagcttgagaccttgactctgccttgctcctgacattcaaagaggaaacctcagaggacaggtaccaggcctatgctacctccatgtacgaagttcaggagcaaataggacattgagatgataagcctttacatgtgcagctccctctgcctggaaagctgccacctgagttcttcccctgtggctccttctcaaaagtcaggtctcagcttaaatcctaccctcctcagagaggtcagatttagaatagggtccccactgctgttattccccatcctgttcatttcctttatgacatgtgtcatactttctacatttatgtttgaatattttactaacttcagtctcccccaaatagaccgtaagttccacaaaggcagaggccttgtcttctccaccattgcattcccagtgccaagttcaatgtcaagcaggagaagggcctgagtagtttgtttgaatgattgaatgatgatggagagatgctggtaatgaagatgaaatggtaagatgacagtgaccataatgaaggagattttccctatgaaagacgatgctggtgctcattgtgaagatgaccgctcatggtcctgccagggtattgaacaccaagctttcaggtgtagctgttgattttatctgaccaccttcaccagtcttatcccaatgactgtgaattcgtaaccaagggcagctgtgtcccagcacatccagccttatcttcttccttcttgcagccttgacttccctattggtgctcattttgtgctggagagaccaatgggcattgccattccccactccaccccagcccacttcttctcctgtgttcctctcttcaatacatggccccaccatagtcattcagccagaacttgataatcatcagcccctcctcctctctaccccttcatagctgcctcagttcaaggctggattctcttgcctgcagagtcacaaaaaaagttttatagctgatttctgggccttcctgtttaacccacttaaaattcagaatgattattttacttccctgcttaaagtctcttaatagctttccacagcttatggaatcctctctggcttatgaacaaggggcagggttcttgctcctggtccatgctcctcctgtgttcattttgggcctcatatcctgcacttcctctcttgctccctgcacctgacttgcaatgccccaaatgcaccagggctcttttcggctccatgccaatggcaaaatcttacccctcagttcaactcaaaaatcatcctgtgggactaatttttccgagcccttccagcatcaccgccctcttacaggaaggttgatgacttgtttcaaggacagtcttagtttttgtcttgccagggcttccactcccagcctgagttttggggagggcagacagtcacatgatctggatccagccaatgaggacatcccttggctacactggtattgaggggtgggcacatgactcaggctggtccaccaaggtttatccgagggcttttgtaggacccattaggaaagatatgctccctttctgctgggattgccaagagaggtaggttatagggagctgagggtggtcccctttgccacctcttgggaaagcctgcctgagaatgaaactaacacacaagagagcaaagccttgggatggggagaaacattatttgcataccttgatccagcactgcctgaagtcaagttctggacttttcagttaaagaggccagcacattccctttgtagcgtgagttagctggaggtgggtttctatttcttaaacccaaagaatcctggctattacatttctccttatttcctaggggaacttctttatacctcttagaaaagcacctaacacatgatattgcaaagcatttaattatattctgcctctttgccccgactgtgagcttcagggtccagcacagtgcttggctattacataaacatttgtggaaggaataaataactccttaggaacccagactgtggctttgtccctctagcacctaggagagcctcgttcatagaagagtctcaataaatgattacagaaaataaataggggaaaagtaacaaagaacatgaatgagctaaaccaatggtttgataaagcatatgtgaataaataaataagtggatagttattattaacaaatctccattggcgtgcaattctcattctaactatatctggatctaatggctcttaaatgagatatctagttaaacgtcactgagatcaaatggttctagttggctcaaattccatgggtaaaatgcctaataattaaagcaagatcattcaagaggagaaagagtgttgctagcaaaattttcaaagtgaacgtctgcagagtagacagtttttgtatcgccacctacaaaaacaaaagcaaatgaatgaagggaatgaagtgaagcaaatccgtcaaagctctaaggacatgaaaaggagggatgaaattaaggaaatttaatgttgaaactcaaaagggttacttgctggacctagagagtaggttgagcctgcttcccagggaaattctctttccaaaaacagccaaagtctacccagtggccacagggccaggatctgggaagtccagacagatagagcaggcatcctattcttctgcaggtggagggagatgcctaggctcaaaggtagatgccagagccccggggtgggtgcatgctggacagcatcttccttagagaatttctgggactatttcttcttggactgtgtcccagggatcaaggaactcccacactttggccaggaggactaggcagaagccctagaagaatgcgcttcccaccacctcatctcctatattaaaatggtatgcatccttctcgacctgtctcaagtgcagcctctgccttgaggccttggtctcctgccccaggacagtgtcctcctctgagccctggaaggtgctctcctttctcttcctactttgaatgtttggtggagtttattagcacacagttttgtggggactgggcctgggagtgtggggacatagagaatgggcaggcagagcccatccagggtgatccgagtgaaatagataaaaaaagaaaatcaatatacagtggccagggcaaggaagagagactgggaaccactggccaaaactaacccacagagtcacagccaaggaaattggaggggcagaggtttgttccaggatctacacagaaatcccacgggtggaaaggagctttggacgacccccgcatcatacacccccccacacacactcctgaggctggcacttccactggcccccaagacaagagtggcttcaattctgagtgcaggtcagactctgtctgccttccctgttgtaggaagaatttgccccttggggaggggtagaggaaagaaggagagaagaaggcccaatagaaccctccaaccacatggtccagagagagcgagggggcacaagcagagatgcccctcccatctctggtagttgtctcctgaatgccttctccatacttatggtccctgcccccctactctgtgagcaccccagtacaggggctgtgcctgactcactgtggagtacctctgctttcctagtcctgcacagagctcttagtggtagctgaattggtagaatcctcttctgcttttctttttctttttgctttttagacagagtctttcttactctgtctcccgggctggagtacagtggcacaatctcagctcactgcagcctctacctccagggctcaggtgatcctcccacctcagcctcctgagtagcagcgactacaggtgtgtgccaccacatccgtctaatttttgtattttttgtagagacaggtgtctccatgttgcccaggctcatcttgaactcctagactcaagtgatccacccacctcagcctcccaaagtcttgggattacaggtgtgagtcactgcatccggccctcttctgcttaacaaagcagctaactggccagtgtggggctagatccaggaacagaagtgatgctatccataatgtgcttgccaagtgcagctctgggaagatagttccaacaaaatcactgtcccctcttctaacttttgcaaggacatcctccagtctcacccagagactctccccacactaaccttatctgagtttccaggcaattccccttgaggctagatagagtcagggcagccaggctgtgcctttctgctggtgagatgccactgggctggaaagctcatatgttggcttcagtgggaccaccaaaaatagggccaacgaggctctgaattgctggggttgctccatcttactcttttcctctcaaagcctcattccaggagtattgtacttatggtgagccaggcagcagttgccacgtttcaccctctcaaagtgttttgtaggttggtatactgagacccatttttcagatgtggaaacaggctcagaaaagctggtaaatatcctaagatgacacaactactgagaggtggctggttttgagcccaagtgtctctgctgactcccaagcctacccccttcccagttcgatgccatggtgcaggctcgatatctaattccagagaaactgcacaaacttcctctcctatattctaggagaggatgtctggctttccctcctctcttttaatctggggatggttctggagagactcagatggagagtgttgggtatgagacagaggaaagaggagacagattctggatctagtggcttctcagggggcttcactttgctgattttctcaaccaatggagaggtcagttctgtgatgggctggagatcacttctactcagtataacgtgatcctgatatccttcagggacctacatccccatattgttaaaagggtcttctgtatccccagtcccagtcctttgaaaaagtcctggggcttcatgaggaagcttatcaaaggtgagagtgttttcttagaacgtgatggaaaggaatggagctccatgatggtcagagccaagtgactgggtcagagcagagcagagaaagaaaacccaccacccccacactccagcagggtcagtgagagaaagtctggctcctacattgaactggaaatggaactgtgtgtaaggggggacaggtgtgtacatgtgcttaaggtggtctgggggtgagggatgacttggtgatgtgaatttggcagtgacttggaaaggtatgtgtcagagacgatttggcagtgtgtgtgtgtgtgtgtgtgtgtgtttgtgtgtatgttgggtgagggctgcacacatgtatgtgtagtcagggtgtaataccaattcttctctgtgggttgtaaccctcagtcagtccaagcccagcttttgctcatggtcacacacacaaaaatgcaattaacttttagggggagtaagtctaaaatactagggaatagctcaacatgtcagagctacagggttcagtgctcaccacagtaacagctttttcctgttcaaaacatgtattgttggattcccaaaggctggaccgggaccagcaaaacagggagaactggcccactgattgctgcatgtatactgttggccactccagtgatgggcacatactgttatttatgtgtgctccccgcaccttatctttcatgatgtcaggacaacacttccaattgattatttcctgccacagttttggctttgaattgtcctttgttttatgaataatattctgaggagttggcaggttttcttctaacatccttacttggcaaaataaaaaatgaccaatcctatgtttctccaattgtttggaaattttactagtccagaagccctaatttgttgctatcccgtttagggggaggggaagagtgtggaaactgagtcagggacattgcatgccactctcccttctgaatcagtgggaacttgttatctggtaagggaggtagtggattttttttttctctcaaaggaattcttgtcttcttgataggtgaagggggtgcccagttgtccaaatccatctttgctaacaggatctgttgtttttctatgccttggcacagaatgcaagagaacatcctgaaatcttaatgtatgcttacaaaagcagtatactcataaaccagcagcatcaaatttttacaggaatccagggatccataaaggagaggggcaagggagagagctgattcttcccacacatacgtcctgagtctccaagtttgtttatccataattgctatgcaagtataaattagaacaacaaatgcatccatcctggcagtggtgacaccaaccctgtaaataattataatgtaatcttatagcaaagagttctgagtgactcccctaataatttcctctgcttaattccttccccactgagtgacttaataggaaaaggaactctttcagatttgtttcactccaaaagtttggacaacgtgtagactcacacctggagggcagaagctgtaggagaccatttggcccatggataaacaagtgagtcgaaaaggccttgggactggaagacagggaactggcaagggtattcgtcttggcacctgtttatagaagtgaaaacttgggaaccacctaacaagaggtctgatgagtaaactatgctacagtcttacaagggaatgctacatagcccggaaaactcatcacagatatcgcatgtcataatagcatgctgtcatggcttggaagacagcctttagtatcagattaacctggggttgaatcccagctctgctccttactcgccggtgtgatctcaagcaggtagtataacctctctgggcctcattttcctcttctgtaaaaggaggaaaactatgctacttacttcatataatttttatgaagatgaaatgaaattatagctctaaagagcttataacctgtctggcacatattggtagtaaagggtcaacaaatgatattattatcagaccttgtatattttggaggcatctgtgatggtacaggaaaacatttcatgacacaataattagctaaaaatatataactacagatatttttagatcctaatttggtcatattaaatatatataaatagccagctagcttaatctaggccaagaaaaaaggtcaaaggggagtacatcaaaattgtaataattttaatttttccatacctttgtagattttccatgttttctacaaggagcatatgcattacacttacagtcagtaaacaggtattttacaaaagaggcagaggtccaagggtcttcacactgcgcagatcatcaggattccagttgagtgaagactcaccttaaccttcaacccaactcctagcttaaaatcaccagcttttcctcttggactagtttatagaatgtcatcctccacagagcaggttgtcctcactcacctgtgcttctctcagccctctgaccagggtaggaaatgacctggccagcttcctgtgagaagctcatggtgacaccagggtcttctgactcccatgtcggctcaccttccactgcaccaggaaacttgagttttctgcttatgctagttcccaaatctgagcctatacttgggaagaatccattccccctttatccctcttaaatatttaatagtcacacttggctcctaccatgggtttgtctgattttcttacctaacagatagatagacaatgagctccttaaaaaaccatgtctcactcaactggtgttcctaccgccatgaaacctggcacagggaaggtgtgcaataaacgtgccccattcccctccttttctcctctccttcccatcttcctcctccctactcccactgactgccacgtctctgtcttctctgactcttgcagacacccactttctgctccgctcagaatcctcagtgacacctcctcccacccctatgccctccgtccatccactcctggagcacagccccgccagacctggccgggcccagccccgcacccagggcctccaccagaacgctattcccactgcggcaccccctggtagccaacgccgtgactcctgcctgacatcaggaagtggaatccccaccttcacctgacactatgcagcaactaaggctccaacgatgccccatccttgcttgaagtacacctggacatatccttctattggctcctcatgtgctaacaaaagtcctcctgataacacagccacaatgagaatacaagagagtgttccaaatgccacaataccacttgtgatgcttctcacccaaacagaaagccagatacttcctcaagccatcctcaatttgagcacatcctgcaagcccaagtctgggataagcaacgatggcttcaataactcatatcctccctaacccatcaacaactgagactctccatgaagcacactacagaagagcctgcacttttttagcaaagccagaacaagagggagaaagtaagtcctacccttcagacactgggacataatgcctttctgatgtatcaggacccttggagtgggaagaattaagactaaaaatgttctagtctcagcaatggtcacttatggttctagtccctttttggatgctatgcatatgtcttccagaaatggaacaatattttgaatcattttactagaccctgtccacatcctgagaccagaacatttttagtcttaatgcaagttattcaaccaagacccatcataaaaatcttcagcaagaacatgtttcaaatcagatatcaaaatcactataaaaattaccccagctctaaaaatatgcagtgctttttcattaggatgagatgaaaggactctaacagtaggtataaggaagtggctaagaggcctctggctgcaggtccaggcactgaggagactgcaagcatcccagtaattcacagttgcagagaatagggtaggaaaggaaggtgatgttgtgcttaccagagggaggagccttctgtcccagtgacttccagaaagtcgtaaccatcctccagctggaagtcaataaacaccagggcgatggtgtcccccagctcagccaggatggtccatgtgcagtcggcattgttatggtactccgaggggaagtgggggctggagatgatgccactctggccccgcagggtcccaccacaggcatcatcagctgtgggcacagagagaagaggcttacatgagtagtctggttttcaagccctagcactcaccatgggctatacctgcaatacatccttctgtctcccaagagtacaattcacagtttgtggacatagataaagcagcaaatgactttgtttggacaagtccatctgagaagcctaacagaggaagtgtcattagagctgggttttgatgaatgagtaggagttcactagatggagaagagggggaaggacatttcagggaagaaggaaccaaatggtcataagcagagacatatgaacgtgcaaggcatgtctaagataaacagctctagatgactcatcacagggtaaaaaagatgaataatataagatagtaatggcatgtaggagaagtcacatggcagagaacactgagccaaaaagatttggagacaggggagtgcattggaaaggaaatggattttagggtaaggaaggtctagatttgaatttagactccacaatttcccagccacctgcataactttgggaaatttattttttttaaggctcagtttgcttctctgttgtgataactgaattagatagttaatgtgacagtaactagcattagccagtgactgacatgtgggtagatgctaatgctagattctcctttttccttctacttcatcttaaggatcaaaggcagtgaagaaatgtgattaaacttgcattttagaaagaacactggctatggtataaaggaggtctgagtcagggaagcgcatgggatgctcttggtatcaccaaaaccaccacagtccaggtgaggctggatgagatcgagctaaggtcgtgtggagggtgggagaggacttatttgagagatatttaggaagcagaatctccagaattcagcaactaggaggtataaaatccaggttgctggtataagcatctggatggatgaaaggtgctatttcctgaggcagaaaacccaggaagggagctccttgtggtatggaaggcaaccaggagttcagttttggacacgcagaagtgggtatgtctgtggggcctccaatggtgagatcagattaacagatatataggagccatctgggctagagataaaagtgatcttgtttagcagctctgaactattcttactaatgttctttacagggtcaagagaatcatgagccaactcatagcatttctcaatgctaacttctaagtttctatgagtgcagaaatgtaagatatacacctactctcccagagtaggtgcttatgaaggtttccctcctatacccattaactgagcacctactgtgggccaaatactgggtagggccagcactacaatgtgaaaagcttgatttcctctctgccttcaaatgcttctgagggaggaggtgggcaggcaagccagcaatggcaacacagaatagttatgatggggatgctcaaggcgcagtgatagcacatagttaggaagggctttatggaagagacagaatttgtgttaatatattcattcacttattcattcattcatttaacaaatgctaactgagcacctactatgtgtcagccactgttctaggtgctggggattcagctgtgaataaaacaaaaattcctatcctcccagagcttacattctggtcagaaggataaagacaactccaagataaataattaactctatagtaaatgagctggtaagtgcagaggaaaatgggctatctggtgttgggagtgggggtgtggatatttcagaaagggtggtcagggaagaccccactgagaagttgacatttgagccaagacttgaaggaatgagagaggaagacacatggttacctgggggaagagcattcacggaagatagagcagcaaatgcaaaggtcaccagggtgcagaggcctggcaccgttgaagagcatcaagagacccaaggactgggcgcagtggctcatgcctgtaatcccagcaatttgggaggccgaggtgggcggatcaactgaggtcaggagttcaataccagcttggccaacatgatgaaaccctgtctctactaaaaatacaaaaaaaaaaaaaaaaagttggctgggtgtggtggcgcacatctgtagtcccagctacccgggaggccaaggcagaagaatcgcttgaacccaggaggtagagtttgcagtgagccgagattgtgctattgcactccagccagggcaataagagcgacaatctgtctcaaaaaaaaaaaaaaaaaaaaaaagagacccaaagggctggaatgcaggaagaaggaggaaagtggcaggggaggcagggcttccgagggcctgagaggccgctgtaaggatgtggacttttactcggaatgagttgagaagccagtggagggttctgagctgaggatgatatgatgtcatttgtgtattaacaggatcccttgggatgccatgtagacagcagaccagagagggcaagggaacaaggtgggggcctcttgaagctaccccaataatccagtgagaggtgatggtggctaagaccaggtggtaacagtgagacatagtcagagtctggcttcatttccaacactgagctggcagcatacatcagctgagggtgcctgcctggtaggcctcaggggagagggtgttttaggcagaaaaacagcaaggacagttcaagttggggagtgtggcatgtttagggacttattaggcaggaccgtctgaactgaaagggacatgcagagatgacagagctgggctggacaggaaggcaagagctggactgcgaaggtccttgaatgccgagtagaggagctgaggttctgttctcctcccctcttcctcctttgctaccctcaacccagcttcccaggccccagaaagcaggaagggagggaaggtaggcaagattggccttgcttggctttaaatccagttcagtggtgctgttgatttgttttatcaagttgcacagtatttctgccttgagtatctctctggcaggaggctatgatgtctgacatctgaggcagagtttgtcgccttctgatgtaaataaattcaccatgaacattaccagggagataagccacaggagccagccaacaagtgggagatttgccaatattgttccgagcaagcaccgggcccactggtccccaacagtcctgtcactggccctcactacaccaggtggaactgtcttcgccctgggcacaatggctgagtcttgactgtactggggaaagggatcatggtgaagaaagggacatttagcccgaaccttcaaaaaagcacaggagtgtgctggaaggggaagaaatagaggggttccaggcagagcaaacaggccctcagaggcaagaaggcctggaagggcatgctgcttgggggaaggccttgacagcactgccgaggtgtttggactttcctctgcaggtgcaggggagtcatggtaggtgtggagaagagggttttcagcaggaagtacaagtccagacctattttagaaagatgatttggtcccatagtaatggatgaaagatatggtttggtggccagggaaggttgccggtggggagatcagagacagagaatggagaagaggttttcccatcatcaaagctgcaactaggcagggaggaaagagaagcagcaggaagggatttaggaggcagactgtggaggaatgagagggtgaagtctccaacagaaaatggatggtgaaggagagagcagagacagggacgctagaggagacgcagctctgcaggaagtgacggcccttcctccctgctcttccccactcccatgctgagtgtgagatcctggggaataaacagatggggatacctatgggcctgggatcccagagactgtgaggcagggaatcagcaggacagagagggaagctcccaccacaggagtggagaaggctggggactgaacagacctgtatggagcaggcagaagcaaagatacctgaaagaagagaaggtgggaagggaggggcactcaggtggaaagtaagcaggggccaaagagaaacattagagggggagggagtggctcaggagcaggcacagccactctgtgtggccaagtctccaatcaggcccttggtccacatagtctcatttaatctggcctgcacatccaggtggacaacaaagaattccagaagaaaagcaggtcttgggggaaagacaatgactccagagccttctgcctacttccagtcttagaaacccaactagatattccacattgctctcaaacccaacccaaccaaaatcactctcatcctttcctcccagaagcctagccttcttccagactttcccatcttggagggtcagcactattcacccacttcctcatggcagaggctcaggggacatcctcaactcctcccacacccccacatccagccagggactcagctggcagtccatctaggtggctgtcaatcctgtcccccgccatcactgccattgctgtaccccaagccatgtcacactccaagttaaccacagccatgaagccccctcctggtctccaagcctccttcctcctccagcccatccattcttttggtttttcagttttttaaattttatttttaattgacaataattgtatgtccttatggaatacactgtgatgttttgatatatgtatgtattgtggaatgactaaatcaagctaattagcatatcaatcaactcacatactttttttttgcattgagaactttatcttggagcactcccttaaaaaatttattgttataaaatatttgtacatttttatggggtatgcgtgttattttttgacatgcatagtaggtgatatagtttgaatgtccctcccaaatctcacgttgaaatgtaatctccaatactggaggtggggcctggtgggaggtgtgtgggtcatggggatggatgcctcatggcttggtgctgtccttgtgacagtgagtgagtcatctcgagagctgattgtttaaaattgtgtggcacctctccctcactccctctcttgctcttgctctggtcatgtgaagtgcctgctcccacttcaccttccgccatgagtaaaagctccctgaggcctccccagaagctgagcagatgccaatgccatgcctcctgtacagcctgtggaaccatgagtcaattaaacctcttttcttgataaattacctagtctcaggcatttctctacagcaatacaagaaaagcctaacacagtaggtgtaatgatccattcagggtatttagggcatccatcacctcaagagtttatcacttttatgtgttgggaacatttcaagttctctctcctagctattttgaaatatacattgttgttttaactatagtcaccatagtctgctattgaacattagaatttattcgtccttctacctaactcaggggtccccaacccctaggccatggaccgggacctgttagaacctgggctgcacagcaggaggtgagtgttgagcaagttatctaatgcctgatgatctgaggtggaacagtttcatcctgaaaccatcccccacctcctgtccatggaaacattgtcttccatgaaattggttcctggtgccaaaaaaggttggggaccactgacctaactgtgtatttgtacctgttaaccaacctctcttcatgccctacatcctccaatcctggacacacacagccttcccagcctctggtaactatcaatcattctactgtcaacctctatgagatccacttttttaactcctcgtatgagtgttaggtgatatttgtctttctctgcctggtttattttacttagcataatgacctccagttccacccatgttcctgcagatgacaggatttcactcttctaaaaaaaaaaaatagagatggagttgtgctggacattgcccaggctggacttgaactcctgggctcaagagatcccttgcctcagcctcccaagtaactgggactatgggcgcatgccactgcacctagctaatttcattttttaacatctgagtagtattccaccatgtatgtgtataccacatacacacatatatattacatataccatattttctttatacatttatctaatggtgtgcacttgtgttgattccatatctttgctgttatgaattgtgtttcagtaaacatggggtgcaggtatccctttgatacattgatttcctttcctttggataaatactcagtagtggaattgcttgatcatatggtagttctatttttagtcttttgagaaatctccatactgttttctataatggctgtactaatttacattcccaccaacaaagtataagagctcccttttctccatatctttgccaacatctgttgttttttgcttttttaataatagccattctaactagggtaaaatgatacctcactgtgattttgacttgcacctccctgatgatcagagatgttgaacattttttcatatacctgtttgccattttaatgtcttcttttgaaaaatgtctattcatgtccttagctcactttttaatgggattgttattattattatttttttgctgttgagttgtttgagttacttgtacattctggacattagtcccctctcagatgaatagcttgcaaatattttctcgtctttaacaggtcgtcttttcactttgttgatggtttctttttctgtgtagaagctttttagtttaatatagtcccatttgtctatttgtgtttttgttgcctgtgcttttgaggtcttagccataaaatctttgcctagaccaatctcctggaataactcccctaagttttcttccagtagttttatagtttggggtcttaagtttaggtctctaattcattttaagttgatttttgtatatggtgagagatgggtgtttagtttcatttttctgcatatggttatccagttttcccagcactattgaagcaagcgtccttcccctaatgcatgttcttggtgcctttgctgaaaatcagttggctgtaagtatatgaatttatttctggactctctattctgtttcattggtctgtgtctgtttttatactaataccatcctgttttggttattatagccttgtaatatattttgaagccaggtagaatgatgcttccagctttgttctttttgctcaagattgctttggcttttcaggcttttttgttgttccttatgaattttaggattgttttttctatttctgtgaaaaatgacacgggtattttgatacagattacattgaatctgtaggttgctttgcagcctctgtccattcttcacagaggccagagtaatacgggaaaccatgggcctgattacaccactctctctgttggaaccatcaataacccccattgtcactcaggataaagtggaatacccgatgactcacaaggaccttacagggccttgcctcatgccagtctctctgtccctactatctgcagccaccctggcctcctcccagctcttccgattcactaagcattgccttgctccagggcctttgaaagtgttattttctctttctggaaacttcttccctatctcgttgggcctgactgccccctcgccctcagcctttaggtcccgatccaagtgctgcttcctcgaggatctttacagaaatagaataatccctcccccatcatatactttctgagcaccacatattttgccataattaatgattttccataattaattgatcaattatatcattacttagttaacatgtagatagcaaactccatgagaacagaggccatgtctgttctgtccctagcacctagcagatttcctggcatacagcaggcacttgactaatatctgctgaacaaataaatgtaacagaaaactgaagctcagagaggttaagtaatgttcccaaggtcacatagggagtggctgagtcaagatttcagttgagtgtctctggtaccaggatggtagtctcctccacatccctgcttgatagtggtttggtaagccatcccgagattttcaaacttcccaactgtaggcaatgatttctggacttgtgctagaactgaggacttgagaacttgagatcctctggccagagctaccagtctcctctgaaggcggcacctttaccattttagccatccctgcctcttgggctcatccgacaccctggcccttgcatcatcctgttttgattgaagatcctgcaaaagctgtttggaggttttctcccactttagacaaggcatcatatttcatggttacaactccagagtcataaaatataaccttcagctgacaccatagtcctaaaatattcatttacactttctccttctctggcaatgggcattttgcaccaccattaagtcatgcatattctcaggtgcaggtgtgttatgctgatagttgcctttccaagtttatgactttatttatgatcgactttaagttctacggaaatctcttcaattagccataattttagagaactctccctcaatcctctttgatttctgttaactctacaatgactgacaaatttcaggcaggaaatggagaaaacaggacattatcctctctacttcaggccagctctagggtaccatcttgcatgcctagaagatttggggtccttggaattggcttctgttcatatcatcttccccaggacccctcagcctctgtggaaatgaagatgccaacaggccccaaaggagaagccaccatcttccaattccagtgcaagactgagagcaccagggcaggagtgccccaaagttgcggcccacccccttttcttgtggtgaatggtttcgtgtgcctaaacatgctggggcccccagaacttgctcaacttcttcagtcccctcttcctgggggctttggactctgcccatttatccttggctttatcaatgacactccttaaaatgaagaaatgaccaattctgagaacatcactattgctcccagactcctatagttacagccacctaaggtatccttctgaggggaagaatgtagacaggacatggtatttgattacatgacactccttagtgagctttcattatgggccaggcattgtgcaaaatgcttcacctgcattttcccctttaatcttcaaaccctcgagagcataggtattatcgtgcacattttacagatgaggaaacagaggctcagtgagtttttaagacttccttgtggtcacatagctactaaatgttggagctagggtttgaacctaagaccttgtgactccaggcccacaccattacccacctatttgtctgcctcctgggcctcagtcactataatcctgttcctgacatgggctaggagcaggctcctggaagcaccagaccctggagatggggttttccaggcatgagacgcttcctcctgctcccttctcttctgcctgggggcctttgtgctgcctcaaaagtgctggtccagctaccagtgcttaagtggaggtgggtgaaccttgggtctggctttcttcataggatggaaaagtagtttccagcccccaccctgaagcagcatctgtccaacagaatgacctcaggccctttcccagaggtttctctcctcaggaatgcatggaaggtcaaggggaaaccgcaagagactgccagtccctgactggtggagccatgcaggggatgcctgcacctgcaggccaagctctcaggccctgaaccatcaggctggagaagctctggaaatcacagcatcattgtgagtctcctgctgtgggccagaggccaccatccttgcctgcagtggagggtggtggtcaagatcatggctgttaggcacgtggacttgcgctgaatcctggctccaccactctcaagctgtgtaatcacaggtaaagcactgcacctctctgggcctcagtttcctcacttgtaagaggagataacattaccttaacctccttgggagttgtgaggattacaacaggtaatgcaggacctggtacttagttagggctcaatatggtggccagtgaggctgtggcagtgagaatgacaatgatagatacccctcactgagtcataactatgaacaaggccctctgctatgtgcttagcatttatcaatgtgaacctcactgccaacttatgagttaagtaccattattattcccatttacaaatgagaaaactggggcatagagaggttgagtaactggtcccaagccactcagccagtgggtgtaagtggcaaggccaggatttgaatccaggtgactggcctccagagcccatatcgtgaaacgttctggtatagtaacagtaattgcaaaagtgatggaaggctagttatcccagtagcagtagagttaccctatcgtaaagagtggccttgggtagctgtggtcgctgttgaggccccagtgctcagaatcactcaaggtgcacactgcacccggcatagtgtttagtgccttctccatgttgttaaatttgatcaacacaatggtgtccagcatgcagtgcccagaccctctttgctatctacagtgttgccctcttatgcctttcccagatctctttctagcttaggactccttccagctgcagaatcaatgcccccatttggatgtctcacaggcgtctcaaacgttacctggacaaagtgagctgtcttgcttccctttagggcacatgcttcctgccctctgtgccagtcatctccatcttggtcattggcatccccacccaccagccctccaggaaaagcctaggagtcaactttggccctttattctatcagccatccaacccatctataaggtctgttggctgtatccccaaagcacagccccaatctacgcctgtccctccacctctactccggccaccctcgaccaagatgcagcaactccagcctggttgcccataatagctgcctcctaactgatcttcttattgtggctcttgctcagctagtatccagagtgatcttttaaaaaaattaagttaaattggactatacttctgcttaaaactctcccctggttgcctcctgaactcagaaccaagcctatactttttttttttttttttttttttgagatagagtcttgctctgtcactcaggttggagtgcagtggcatgatctcagctcactgaaacctccacctcccggattcaagagattctcctgactcagcctcctgagtagctgggattacaggcatgtgacaccacgtccagctaatttttgtatttttagtagagatggagtttcaccatgttggtcaggctggtctcaaactcctgatctcgcgatctgcccgcttcagcctccgctttcttaccttgcttcaccccatccctgccctctccacccacccctcactctacttttgccacaggggcttgttttctgttcctctagcgtgtccagtactttcccccacctcagggcctttgcacttgctgcttcttttgccaggaatgccgttttccaggtcttcacacaacaggctcctccttgtcacaggactcatttcagaggccacctccccacagaggcctcccctgactgctccgtctaaagtagccttccccatcactggctaagactttacttcctcgtagctcctaccaccacctgtttatttggcgtgtgtatctgttttctgcctcctggctgctagaatgtaaactccaagagatcatggaatttggtcagatttgctcatcattccaattctctgagtctagaacaatatttggcactgtataggcagtcaataaatgataattgaattaatgactggctggctcataacaggcactcaagagaaagttgttgagtagccaagtgaataaaatgaggacacaatcagccctgtaaggctgctacttgtgtcccacctttaaaactcagaggggtttagcagcacccctggcaaccacacagctaggggctggcttacctagggttgaacccaggccagtctgactctatgcactgtccatacccgacaccactgcttctttttcacattctgcaggtttcttcccctggggccagaaaatttggaatacagctcagcgcttgcagtccaagcttctgcagaccgtattccgtcttccccaggtatggtgacagcctgccgtgtttggcttgaacctcagaggctaagcacttcttgctctggccagctttctccctaccacctgcctctcagtccccagtgcatatgaattccgtcacttccccatgcagccttctttgatccagggccaatggccctcataaatcagaggcctgttgctgaaatccacatgatcttccctcttgtggatcaaagagatgacacaaagctcagcacctcccagggacctctgcttttgaaaacgtgcccagtgtgacacaaagtgaaggggggtcacaggccccatctccttccctctgtcagctggaccaagccttgatgggtcaggatctttgggatgggcctccttgggggtcggccttacacctggctcccccctattcccagctgttccctattcccccactcctagtctgtgctgtgtccccagaccaagtccaccctccagctgggcacatgacatttcctagataaaacagacacacacggctttccagtctgctccgggaagctttggacttaaagagattgtcactcagagctactgggcaggtggggtaacccaggctagtaatttccctttcgggcttgtatgctagcatgattctgatggtgaattagacccatccagacagccgttcattcagcaaatatttacggaccactgcccagtggatgaggtttacccactcgcagatgccagctcttgagagttctacacgagaggaagaaaggccaaaaggcttttaatgcttcccaagtatgaacctgttcactctggcatgaccaccactcctggcacaggatgggtgtatggtgggtaccctttgttcctgtttagcttggcctcctaaggaagaacagtttgggaaatcacttttataaaatcactgacattattgaggatgtttcttaggatattcttgtagcttgtggggattataatagagatgaacctgaaggtagggaggtgactgggggtggggggaagccctagggggtctgagagttggaaagtcattttattctctcccagcctttgagcagaaccacatctcagacccctcaggcagcagggggctggaagcccttctagaagcaggatttgacatcctcagctggcttccctagggcgtttggaagggagcattctctggtgtggctaaagtggaagctacttaaaataagtctaagagacagactggaaagattggggtggggctctttctggaagagccttctgctccatgctaaggaatctgaactagaccccgtcagtgatgaagagccactaagggactgagccactcagttttgtcagatctgtgccttagcaagttctccctagcagtacaggtaggaatgggctggtgtgagcaggagagaactggggcacacctgcctacagagggtcaaccttcagtgaggcaagtgagagacgagagagcctggaccatcatctgaagagcaacagagatgtggagggggtaggctggtgcagagggacatgggggccgatgatgcgatgtgaacagcaagaaaagcaagaatgtaagatgccctgaggggttcagcttggccactgttggtggggacacttttcactgagctggggaaggcaacaaaaagagcaggtttggggaaagcaggaagagtgaggttttcatgggccaagtttgaaacaagctgaggagaactttagcatagttcactctccacaggggcctgaagctcaggacagagaatggggttggaggtggggattggagagttgccccctagtaacaattacagcaacacagtagatgagaaattccaagagatggaagaaatccccagagaagaggccgagctgggccctccagtatttaaggggaatgagggtggaaagtcagtgaaggagaaggagggaaagaatcatcatcatttcagacgacgaaaaaagaattggaagacttcagagagtcgtgccaccaaaagacatgccacccccgcccaggcccatgaattactgtgtggtgtgaatgccagaagagtggtatctctccaccctgctccttccctcggaagggccagcccttgctgcccgctgtgcctggacacaaagacactgggttgtgagccttgattggacatgaagacatccaagaggtagaagacctccatgaggtgcccctcatcacttatctctggctggtggggtaacaaaaagatatgttaacatccagccccagagtgtcttatagaatgagagttctctttgttcaggaaaatactaccctatacctaaatagcttggaggaggaggggagacattagactgcaaggagatgacaaaaccaagaggaaaccaggctcttgtgcctaagaagttgatggaaattctgaaatgggctcaaggtgcaggcagcaccaaggtggaagaggctggagaaagaagagagggtacaatgcacatcacaggggaacctggagcctgccaagacagaagccagggagaagcttcccgggaggaggggccaaaagactgtgaagctcctggttgctcatactttcattttaagtcatttgcattgctaagatgtaagctccttgcattgccacaccttccataaagcctgaactacatgcagacgccttcgttgatgtttttgtttgttggcttgtattttgtcttttggagaagtaggggatccaagaaaaatggacccagttcccaacctaagttggcagagcagaagcaggggtagggagacagggcattgagttcaagattcagaggaagctaaagctgacagattcctggagatattaggagggttagtggatttccaccatattagcattggatattgctgagtattttacttccccaagcagagtgatacccccgctgcatccagtaattggattacatttgtttctggtttttatcttgaacaaaatagcatggcatttatagtgctgcaaaaagaaaaagaactgcagtttatatttcataacttagacacttgattttatttactatcatatttcatattctatcatcgtgtcacaactctgacaccctccttggaagatcagaatgttaacggtaacatccttaaggcagggggtgggtaaggatgctataaggaagggcagatacagcagctttcaggctgtggttaggccacacacctgtgtaggggccaaggtctcacctgattggtttggtaattcctgaagtccatcatggaaagaggcagttcctgagttaggaatggggcctgggaagatgggacttaggaaagcaggaaagggaactctagttcccttgtggtccaccaagaaggctcaacatggccaaggcccattctattggttgaggagaggtaaacaaaggtgaagtcaagtggcaactcagattgattggctgtggcttgcctattgggagggaattcacagctgtgtctggacccaagcagaaagggtgcaatgaacaattaattatgtctgccatgggattgggaagaaggggaataggtatacatgccatgtaatttttatccttggtgtcaataacaaaaagtgtgtgcatgtggcaggaagaaggagttgcttatccctggagctagtcttttacagtaattacagaaaatcttcctccaaaagaaaaataaaatttgaactaaaggaggagctagttattccaatgacttctcaactcctggaaatgttcctcccagactgatatatggatgttcaggatccatggaatttagagatgagcgttactagaagaaaagagtggtcaatagtgcaaaggtttcttaagaggtcaagaaatacaagagccaaaacaattcccatctgatttggcaaaatgatgcaaatattgagggcaaaggccagtctgcagaggagtaaatgagaagggaaaaggagggacaaggctggatggagctttcaagatgctgggctatgttgatggcatgggaaatcttacagtgtgatgtgattgattgtttttcaaaggtggttaaaaattgtctgcatgcatcataatctcaatttatgtacatatttgtaatatatgcatatgtgcaatacgtattggaagaagatggaaaggacatacattaaaatcacagttaaaacaggtaaattttctttcttctttattcccttctgtattttctaagcttttaaaaatgatcgtgtgccacgtatggtggcttatgcctgtaatctcagcactttgggatgccaaggccggaggatcatttgagctcaggagttcaagaccagcctgggcaacatagagagactctgtctccatgaaaaaaaaaaaaaaaaaaaaattagccgggcatggtggcacatgcctgcggtccctgcaactccagaggctgaggcaggaggatcgcttgatcccaggagtttgaggctgcagtgagccatgattacgtcactgcactccagcacggaggacagaggaagatcctgtctcaaataaaattaaaaaaaaaaaaaaaaagaaaaaagaaaaagaatgaaagaaaaaagaaaggaagaaaggaaaaaaaaaagaagattgtgtaaggaataggctgggagtagagtgacaaatgtctctgttgcctgaaactgagtgggtttccaggatgcggaactttcaggactaaaattgggaaggtcttgggcaaatatgaacaagttggtcaacctagctgggaggctgaggccgacacagcatagaagagaggtgtttttctgggggagggggttgttggagtaaagagattttgagcatatttggaggctgaaaggaagaaactattagatagggagagaggctgaatttataggaaagagaaaagaataattcctacagtgaggtcagtacgaaagctgttgggaaagtgatctggcttccacaagaggagagagggtctgcaataggaagagaaatgatgtttcttctgagacaggagggctagaggtaagggaagactggctacatataagtttgttgatacaggggaaaaaatgagggagtgcacacttgagggttaggaggtcaggtgaggttgaaatacccctagaacacttgaggaccctgaaaaccctctgtgctgtccagacttgggtacccccctccctgctggggtgtagctttgccctttgagactggatgtcactggaagctccagcatcacctcccagccactgccccactctgtcagaccccttgctggccacctacctctgcaggaaggcagggggaagtcccacgtggcgctgttctcagagccagcgtggcaggtgagcacggcgtggccctccaggaagaagccaaggttgcagctgtagcggaccttgtcaccgaggttgaaggttgaaccctgctggatgccattgggcagcctccctgggttcccacatgtgtggctggggagaactgtgaggagaaacagagaaagagacgggtaccccgtgagctgggctggagccctgacaccgggcttcctagtagcaactccctaggccactcgggcttcctggaactcatttcttcttctgtgaacagcattgcccactgctgatctgcccgcttctcaaggctgtagattccctgggaatgggttactcataagagacaagggttactcaaaatctcacacatgagtttacaactggatgtccaggtctcttgccttttctaatgcgcagccatggatgtgaattatgttcatcctgatcactagagatgcaattccaggaatattactttaacctcttgggcatggctggcctgatttcagactccacactcctcactaaataccatggaagggacataaggcatggcataagagtaggtgctcattaaatccagtgtcctttctttcatgtgtgatccaccctggcagccagaggggcactttggccccgcaggttcaggggagttgaaagggttggattaggcagaataggcagtgaagtgggaaaacaagaacccgggttctcatcagcctgactggtttaaagggggaaaattgggagccaggaaacaccatgcacagtgtgtggccagagccaagcaatcatggtcacctgcaagtgtgctctcatgaggcagaggaaatggtcttggggaaggtgcaagagcaccatgacctggcaataaggagggagggaggacacagattctctgtgcccataagtcagtcacctgttctaactgacccagcttccccctgccctctgccttgtcccccagagttagaactgcctgtgccttaaaggtcaacacctcctatcattctaggatacccccatggggtgaggagtaggggtcttagtcatgcccagactaccgtttaagtacctctccattaatccacctggcaatgacttattgaggctgtctctgagaggccatgcagccggatggtggtaagtgcagacttggaagccaccgtgcttgagttcacttcccagcctgaaatcttaccacctgtgggaccgtgagtaagtcttttaacctttttgcactttagtttcctcatttgtaagatagggagctcaacagcaccttccttatatcaaaataattgttgcaagaattaagccagttcaggtatgcaaagtgcttaggacagagcctgatgtacagtgagtacaacgcaagtgaatctaaccctcggtacagtgggtgctgtgcacaattaatggcacactaagagttatgatgggacaggaacaggtagggaaccaaacccagctgggggagaggtcagagatcacttcctggaggaggtgacatctctgcagaaccctgggagattagtaagacttagctaagcaaaaaagagcaaacagcatgtgcaaaggccctgaggccagagataacccaggagctgagggagcctggagtaaaagagtggggtggcagtgatggggaagtggaagtgggcaggcctggactctaaatggcccccctagtccttgcaataccctcttcctgccaatgttgctgttagtatctgccttccagaaccctctaccagctctgatgatctcagaaccctctgaaaaaaggtattccctcccccttcctctcttcctcctctgagaggaaacagctcagtgtagagggtaatggtagactttggaaccagcctgatctgggtgtgaaaccaggtgccatcatgtcttattctgtgtgaccttgagtcacatgaactctctgagccttagtttcttcaaatgagaaaggagtgaggccaataatatttagcggttgagggagttaccaatataaatgctgcatgcctggcacaacgcccagaacatagtaggtgctcacaaaatggcaaatgttctcattccattgggccacagggccatgagggcgtgggcctagtctggttcataggtatatcctgggagactagcacagtgcctggcacttgtagggacatatgtgcatgttcattaattagttatttggagagttactcattcatgtattaattccttcatgcaacaaaaattcattgtgggcttaccgtgcttggcacagtggggccagccctcagaggcttatatttttgtgagagtgaatcttaaagactgaagagctcttccttgcccattctttacctgtgccaagtgagatgatctagatgaaaagatttacctctattgccctgtccattggcccagcttagcatttcccatgatcccacactgctagtttacttagcatttcccatgatcctgtgctgctggcttacttagcatttatcatattcccctgctgctggcttgcctggtgtttcccatgatcctgtactgctgctggcttacttggcatttcccatgatcccctgctgctggcttacttggcatttcccatgatcccatgttgctggcttacttggcatttcccatgatctcacactgctggcttatttggcatttcccatgatcccctgctgctggtttacttggcattccctatgatcccatgttgctggtttacttagcatttcccatgatcccatgttgctggcttacttggcatttcccatgataccatgttgctggcttacttggcatttcccatgatcccctgctgttggcttacttggtacttcccatggtctcctgctgctgacttacctggtgtttcccatgatcctgtactgctgctggcttacttggcatttcctatgatcccacactgctggcttacttggcatttcccatgatcccctgctgctggcttacttggcatttcccatgatcccacactgctggcttacttggcatttcccataatctcctgccgctggcttacttggcatttcccataatcccatgttgctggcttacttggcatttcccatgatcccttgctgctgacttacttggcatttcccatcatcccatgctgctggcttagttggtacttcccatcttttgctcttggcttacttggcgtttcccgtgatcccctgctgctggtttacttggcatttcccatgatcccatgctgctggcttacttgatacttcccatgatctgctgctgacttacttggtgtttcccatgatcctgtactgttgctggcttacttaacatttcccatgatcccacactactggcttacttggtacttcccatgatcccctgcagcttgcttatttggtgtatcccatgagatcccatgctcctggcttatttagcatcttctatgatcagtccctgctgctggttcacttggcatttcccatgatgccctgctgctggctcacttggtgtttcccataatcctatgcaggtgtcttacagcagaggcaatgactgtgatgtgtgtgtgcttatgagtgtggggtgggaagggcaggtcaggtaaacatttggagaaaaaagcaagctaaggtgaggggagggagccaactaggggaaatgagctgagaactggtgtagaactaacgtgtcattttccgcaatgagacgcaaagacccaatttaattaaattactaatgtcaaatttttaatgaacctgcttctgctttgggctttcttccttcgaaattaatgactggaacatcactataaataaaagtcgattcttcttaaaaagtcactctcaaaagctcactgctctttacttaatgagctgttcacaatcagaccactctgacctgatgcttccattgggacctgggtgtaatgaatggggctcatttccaaccccacctgcttttttatgccaagctccactcctgagaggtcccacagtggatggagaaaggccagactttaggctcagagagacatgggttcaaatccccgatctggctgcgcaatcttgagctgtaaactttccctcactggccttcaattcttcagaaactggggatactttttcatcctgtaagggtgttttcatttgctaggactcctgtaacagcaccacaaactaggtggctgaaaacaacagaaacttattttctcacagttatgaaggctagaagtttaaaatcaaggtgtcagcagagccatgatctctttgaaacttgtaggtgaatccttccttttctcttcctagcttctggtggtttgctggcaatttttgttgttccttggcttgcagatgcgtcattccaatcctctgtcttcacacggtgttctcttgctttgtttctgtgtctgaatgtcccttttttataaggacaccactcatattggatagggtacacatcctaatgacctcatcctaacttaatcatctgcaaagaccctgttccaaatgaggtcatattcacaggtactgggggttaagtcttcaacatagcttttagggagacacaattcaactcatcacagggctgttgcgcagattaaaattcaacttataatacctacccctgagtgcctagtacgtttcaggtcctggactaaaagcttattttacttttagtccaggacctgaaacataccaggcactttatcttgtgggatatggagtatcctcattttacaggtgaaaaaaaaacaggcacagagagcttcattcacttgcttgcccaaggccaaacaactagaaaatggcagagctaggttgaggacctcggtctttctgcctccattgttcagcactctggaatgtgagactgcttctgacagaggcaaagcatccaagcacatagtgggtgcttaataaacaagagttcccttactcctttcatcattctaggcactgcaataagatgaagagagattacccgactgtccagatttaatagtctgatttttttcccagtctgatttgccagtcctgtactttttaataatgtcaagggcaacatttaaagtgtggtcttttgttatgtgtctaatgtgcaacctgctggacagacataggagattggagataagctacaaagcgaatcctttctaaggcaccgtgttctttgatttttttttttagaatgtccgtgtattttttagcacagatactataaccgttcatgctctcccatctataaagcttccctttgattgcttaccaaatgaagagggggatatttacatccaacgcagcccagaacaatattattaaagcagtgcctgacattgaacaattccattgtagattagctgtggggaatttttgtctcttctacaaagcccgactcttgccaatcaacgtaatattctcagtgattgcatgacaatgaatctcctctgtggctgaagtgcagcaaaagctacatcatgccttcttttatttttaatttgagactttggttcccttattataatgaagagtcatttatgctctctggacaagcaccctccatatgttttgatttcttctcttccatcaagtaacttgtttcatctccatggccatacgattgataccaagtggtaggctagttgggaagaagaattcagggagaaggatttagtcttcccacaatcctcatcatggaaagaagagaaggtgatgcctgtgtacgtgtgtccatatgtgtgtgatctgggggcagtgggcaggatcagggagggaagaataaaaactactcttttttgagtcccagatctgtgctaggcacttctgcatcatatattagcttacttaatctttacgactcccttatttttagcggtttggccttttaaacataattcatagcatacttactctgtgctatccttaatgtcaagtgcttttcatatatttccatccccaaagagttttctatacttgctgtctccatttcctctccattcaactgatatatatttatattttattatacatgagatatataattatacattttatatatgtcatatataaagttaatatacttcatatactacaaatgatatgtatttttgcttgatacatccatctgtttattgttagtctcaccttgctacagtgtaagctccataaggacaggcattttttggtcttttttgttcaacgctgtttctcagttccaagaacagtgcctgatgtataataataacttcataaaagcttactgagagacttaatgatcttatttaatcctcccaacaacctatcgagagaggtgctattattatcatcacttgttgagataagcatagttgccagagatgttggagcatttatccaaggccacgtagctcactgcaggggcagaggcaggttttcacatcactgtctgggattccacatttctgcctgcaataggccattcttgcacagtccattccacaggaagtccatagtgactactgtaccttgaaacattctcacaaggaattcacatgcattctcctgagggagaggatttggggtgacaaccaggcaagctgacctctaggttggtcctgtatatttcctgctacctgtcaatcaaatagaggcagaggtgccagggcatcagatggaggatgccacccacaactagtcagagggccccgccctgctgggctttgccctaaccattgtcaggcagaagccctccgccataagcctattctctcgactcatgtttgtgattctgcaaccttcagcatcatggttatgtggaaagttttataaagatactgatgcttagaccctgtccctaaacctgctgaatcataacgtgagaaacagagcctcggctgctccaggagactgaaaagctgagattgagaacaactcccactaacctattcatgtaagttattccactggcccagctgggtttatctctctgagctttaactgctcaatctccagggcctttcttgtttttaggtttttacttctgacagcagcaaatgtggcctctctcctagagtttcctgtcctccataaaccacactagccctataacttccttctcatttgaagaccctcatggtctcttccctggacttctgtgcccaactctgatcttctcactgctggccttgccctctccagtgcattgtcctcagcaatgctggagccagcattctagaatgacaaattcaccatggccatgccctattgaccctgccaggagcccacattataaaagtaagttccttaccaccaaggcacaggcaaacacagaacctatggtcttctgggtgactctcatgagaatacataataatttgaaagattaatttttaaaaaaaggaaataaaaagaaaaccttaagaacctctctgttgccatcagtacgaattaaagcttaggcctaggctgcccccatccttgtgatctgactgttgctgacgttttttctgccttctctcatcttgtcctctctaccttttctctcaaattcttcatctggcaaactccatcaaagccacacttaaatgtcacctcctccgtaaagccctccttgataccctaagtgtcttgtataacccataagatcccacaagaacacatcttgattgactataaatactgtcacaatgtcattggcaattggctgttagaatcctgaatctcctggcccatgaaataggcaggctccctctgttcattttgttaatgttgcaatctcacaagcccacattttacatgattgggtttttttggaccccatctaaggagttacgtgggggtttccttgcgcttcaattcctgcactttgttgtacattgtaattcattcattcatccacttataacaccctggcttccaaacaggagctgagcctgcttgttgtaattgtttctttaggtgtctattttcatctctggactccttgaggggcaggaacagtgctgtattctttatatatctagcatttgatttcatgtctggcaggaagcgagtgcttagttgaagccggaatgtgttgagtgaattaaatatatatgtatacataataaaatatatattatatattaatcagaattacacacacacacacacacacacacacacacacacacgaagcaataaatagtgtaagaattggcaaacattttccatacagggccagatagtaaatattttttggccttgcaggctatatggtctctgtcacagggacctgattttttccatgcagtgtgaaagcagccacaggcaatatgtgttctaaccaaactttagttataaaaatagccagctgacccacagaccacagtttgctgaccctgaactagtgtttattcagttatgtacttatgtgaggcatatgattcatatctcaggaacgccccccccccaactcctgtgataaaagcaagtgaggaaagctcagttttgatgggagtcaacgatgggaagggactgtggggcgagtgggctgcaccagggaaggtgctggacagaggtgactagcaggtactggaagagacaggcaggtggcacttgaagattgagacctacatcaaatttccttttccctaccatttggccctggggacaggtgggcattgtgctgactgcagggaagggcttgtgtatttatagcctccacccttccccattaaaataggattcatttttagtctttatagctaatctttaggttggtaaagatgacctcattttaccaaagagagagttgaatttagagatccgaagggtcacacagctagtaggagtagtgaaagtaataatagtcacggcttgagtgtttactatgagctgggcacattgcttagcattcttctatttcatcttatgcggacggaggtactacaactgtctcctttttacagggaggaaactgaggaacagccgggctaactcttacccggggctacaatgcaggttgggatcaaagctggggttaaaacccaagctgcttgatctaagggctgtgccttttaccatgttgtaatcttgatctcccaggattcaagacccttgtttgtttcactgcttccccagtgtggagtccatgctcttggtaacttcagagttcctctccttgccaggcctagaggattcccaacccacatccagtcagagctctccttggcccctttcctccaacctagactagctggggctgcaaagacatccatcattgcaccagaggggccacagagaggctgtcagaacagaactctccttgctgcttcctaaccacagaacccatggcttcctctcttccacctgggattctttaaagaagcaccaccaagaaggaaacatcataggccccagaatagagctgccaagtaaaatataggactcccagttcgatttgaagttcagaaaaacacaaacccttctacagtataaggatatcccttgggatatttggaatatgcttatactaaaaagactttgttatttgaaattcaaatttaactgggtttcttgtattttaatttgccaatttgggcaaccctgacccagagggaagaggtatctcttctgcgtcaaagacttcaacctcttaaaaagttggggccatttctctggggaaatggggcagaggaaaaggggaagagctagaccctgcctttaaggaatttaatattgagctggaagagtggatgcagagggggatgtttcagggcctcctagggtaggacctgagaaggtttgggatacagcaagattgcaggggagcagggagccacattgcctccttcctgctcctgtcactctctaagggaagttcagtttttccaaaccagtaacacgtgctgcccctgtttcagaagactgtggcaagccttggtcccttggaggaagagcattaggctggcaccaggtccttcatcctgcggcctatgtgaacctctccagcacctgccctgctgccccctgctcagcccgatctgccccgacagcaccctagcccagggatgatcaaatatatctagacagaaaaacacatggaaaataagtggtaccctatggtgaaacatggctaaatactgttagtattaggcttagaatagctaaatatgcaatttgaggctaaatttgattaattgcatagtggggtagaaaattattttccggtgtgttctatgatacactggctgagaaataaacttaataagaaaaacattcagtgtgtcaggtaattttaaaaaatacaacagaaactccctccctcttgaagaaaccagtgctcacaagtttatctgagagtttctgcaggagaaacctgcttaaccttgcttaatccagaatttccaaaaatttgactacataatcactgccctgactttggaactttactctcagtaatgcctaataaactctgaattgttctgcgaaacacattttgggaggtgttggattctggaataagataaacctgagttgctttactttctgtactagtcattatgaaaataaaacaacaatagcaagggtacttgacgtttacatagaactttccaggttaatgtgaaaatgtttttcttgacaaacatgtctcccactggaacatgcaaacaactgtttgttctgggggcaggattggcctaaggtcttctatgacccattggctagtaacttgtggtggtaaaatcaattcttacaaaagaagtaaacttgtcacttccagaggaatgtagcatgttaagaaaggacaaagaggacaaagagataccttctttcttttcatctgacaacttttttttttttttttgagacggagtcttactctgtcgcccagggtggagtgcagtggcataatcttggctcactgcaaccttcacctcccaggttcaagcgagtctcctgcctcagcctcctgagtaactgggattacaggcgcgcaccacccaccatgtccagctaactttttttttttttttgtatttttagtagagatggggtttttaccatgttagctaggctggtctccaattcctgacctcaagtgatccacctgccttagcctcccaaagtgctgggattataggcatgagccaccccgcccggccacctgacaatttttatagcaggataggttttctgtttgtctgggtcagaatgaccctcaggctttgggaggtttatggccagggctgccatgtttggcccacatccctgtccagctgcagatagaatgtcatctcctatggcctcagccctgaaccaatcctggcaaaggagctcaaagaggaggaggctctgaacctggctggagggtcctgccttgaggctggggtttataactattggtgaggctgcacacctggaaggttactctatcccttgccagggctgtcctaacagactgcataactagccttgttatctccttaacctcccccagggtgggagccctgctctgggccaggctctgctgcccctgcccaaggctgagtcttagtcccctatatcctgctggctggtagggaagtattgccttgaggacctgcattacttgggatgcccataatgatgtcccacacatcaactaatcccttagacaacagaactccagagcccctatttcctccacttggctccccgtccacggccctgaagccccagcacacctcacagccatctctcttaaggcaagagacagctgaacttgtattttactggaagaagcaccatgttcccaaggctccagacccacggcctctctccttccaagaagagttagacagaggggcccaaagaggaactgaggaagaggcgtctgaccaccatcaaccaccttctgcaaatgatggtgaacagggcgactgcaaaagacagggattcaacgtgtggtgcacttgagttcccgtagggtgtcctgtgaatcctcatcctcctcacttcctccttcagcataagcaccatcgcttacggaccacttctatgacaaacttcacacttaatcctttctcatttaatgctcataatagcactgaggtggatactgtgcccattggacaggagaggaaactgaggcgcagagagggtgagtcacttgctcacattcacacagcatggaaccaggggaactggggtgtacacctagtcagcctgactttggcaccttctttcttagctgctgtagaagtgaaggaagagttggtgagtcataagactatcttgctggctacagagtctgctttgaggctttgtttcctacaggtctccctaactgggccaaagatggtacttggtgaacattttgcagtttgaggatcaggaacagtaggaaaggagagcccctgcctcatccattaattttcactcatctctggagtccaactacttctccaaaggcttcatggaggaccctgtgcagggggaagccatctgttcaggtcctctgaagtcatagaggcaggtggtagaatggactctaccctctgccttctgccctggacaagctccttaattggaagacccaaaaatgtcttacacagaaacacaggcatactaacacacactcacactcaacatgcacaaatccatccattcacatcccctttacatattcccctttacaagagacatgcacacatgtacattctcatacacataaacatgcatatataaaaacaggcaaattcaggatgcgtctgaacacagctcttacattcacacacatgacaatggatacaacacacttactctcccacacatttgaataaaccactcatgtttatgtacaagccacgtccatctcaagataccgatccatttccatatagcctctttggattaataaacttttgcacaggtatctctttatacaaccagaacagccctcagaagccagtgttatatcacacactcatggggcctgcctgacacttgtgtttaagctcctgttttcccagacacagtacagaatgcagggatagaggcgcagaggtagatctgaccctagagacgcctcaagcatctgctggctcagtctgtgatttcagaggtagggatcaagggctgtcagggtcagggagacacagggcatcatggtccagaaaatgtctctggtgtcccatagacctgggtgtgaattccatctgtgcctctcctggctgtgggttactggttgtataacaggtatggattaggagagtggactctggagctgtactctgggttcatggtcaaaccccagcactgttacttaaatagtaagctacttcaccttcctgcatctcagcttcctcagcaataaaatgggggtaataatcgcacccagcttagagagctgttgagaggattaagtccaataaaccaggcaaagtgcttatctcagtgtctgacacacaggaagtgctcaataagtttaggatgtgattacatataagcccctggattccctgggagaagatgccagggcagtgtgggagaggctggagctgaaaaagagagaagccgggtacagtggctggggagggcagatggccccaggagccagaacatgggatgcaccctggctctgccaggcaggcggcatcccttagacctacactgctcttgttgagccagggagcggtctgttgctttgaattctaaagacctcccgtacagcctaataagaatcattcgtgaatagtcctacccagctgcaaactgaaatgcaagaggagaccctgtgtatcaatggactcagaccttgtcccctctctgatcctcgcctcagctgccctgtgctgccctggctcaccagccagtggctcacaacttcagggatgaggggaaggaataatttggagaagtttcctggaagaggcatttggtatggtcttgacagagaaggaaggatgttccagagacaagaagtggcacatggccaagagtacagaagcccccactgcttgctttccaggctcttgttcccagggttagtgactcctaacttcctgtgtgcaaaatcccagcccagaccttcctcctgactccagaccccaagtcttgctactttcgggcttctctaagtgaaaatctcagaagtgcctccaactgcacatggcccaaattactctcctgcccttgccccaaacccatctctcccctgggttccttgcatctgggactggcccatcatccagccagccatccaagctgagacctcatctggtctcacacccagtctcttgaattaccttccttccatctctcatatctgcccccaccccattgctcaggctccaggaccaggccctaccctatctcagtttcttctcttggacttggagatagcctcctcattgttctgtcttcagacttgccccaatccaacccattctctaaacaactagtaggatcatggctcttccctcctaaaagcgcttcagttggtgtcaagctctagaatatcactcaaggtcctccatgagctagccccacccatgtctccaactgtacgtacccgtctcctcctcacacccaatgttccagcaacaatggctctccttatttctcctccagcagagagagagagagagagagagagagagagagagagagaggagagtttgtgtctatagtcatgctggtgtgttggtgttacatgagcatgtgtgtgtctatatatgcatgtaaactgcataactatgaaatgtgtgggtatgtgggtatgtgcagggacatggcatgtgggtattcaggtaggagagcctgttgaggatgggcattgagggaaacgtggttgagaagccagtggttggcatagttgggcaagatgacatttacagcaaaggctaggctactgacaggcccaggaactcaaggcctgggagttaggtgttaccaggccctaaatctccccaggtgaaaaagagggagctgcactccacactctctagacctggcctgcaactgtcctggggcacaggtcatatgcatagaagaagccttatgccatgtccctgggtatcttgtctccctccttcctattcagccaaggattgggatgcgtctgtcttcatgtctctgaagagctgctgttgacctcattgttccaccatggtgattgttcaccaaagatagaaagctgttaattccagctcctaactgattacagcattgagtcgggcatcatccagaaccttgggtgtttttctagacacctgagaaccccaatttctctttccccttggtcctctatctgacaatctgacccacagtcattcctgactgacattggccaagtctccaaccttccaccctcttttcccaggccagtctgttagcacacatctccagggctggagagaggctgcggaagccagcctggttctctcttccctcccttgagcaatgagacaagaatttgtctaaatgttagggacattgcactccattctgtcatctgttcaagaggcacatggcttactggagctgctcattcattaactcattcaactggtgtcttcacaccttggtggtttgctgggatctgatgatgaatgtcctccctgccctcattatgcttacactctacaaaaggtgctcttgtatttaaaaaactatcagagcccatcccgggctgcaacccctaagaagaggtgaggccaaatgacctttaaggataggctctgtgtcaagcaattatgccagccatttacatcgttgactgccaagaaaaatcaatctcttccctggctttctcccacctaccccctcgcccgtcctccacttcaggttccctgccaggctcacttccttctccaatcctcgctccaacactcacctgcctataaaacaaacccaggcaccatccttaagcttcttgtgactctttgatgccggcagaagaaactgtctacttcttagcaagacatttaatgtcctacacaatctggactcagccatctgtccaggttttcctcccgctacttccatccctaccacaccctcaaccacgcacactcctgctccttcgtcacctctccttctgtgatctctcctttgtgccctttcacgccccttggcctctgcagttgctggccccacctctgaagtactcttgtgattttcatcatctggcaaatccttctcaacctttcaagactcagttcaaatgtcacctctgggaagacatccccctctcctccgtggagccaagtggtccagtgtgctttgtacacacctccatggacactcagcatggtggggaggccacaggagccaaggtagagagaaggagaagagcagttaagggctgagtcctaggaaactctgaccaagaggctgtgatgaccccaagtatcttgagaatgaaaacttggctggcaatgtgtgaaatgccaccaagatagctaaagccagaacaggactgaacagagctgttgaatttgatggtccagttacagaaccagtggtattaagcagaggaaaactaatagagcaaagaggtagaggtctgaataagaataacagtagtgatggtggataatcttcaagtacatgaagttcttctctgccccagggcctttacacaatattccctggcccagaagttctctgtcttccattctgcattgctcattcatgatcgtttttcagcactcaactcaaatgtcacctcctcagagaagcctaccctgacatttaatccaacctcagctattctgcctcaccaccctttattataccttcagacatttaatcctgacatttaatccaacctcagctattctgcctcaccaccctttattataccttcagagcatttacagtcatgagtaatcattttatgtggttcttgtttttgttgtttacacacacacacacacacacacacacatgcacacacacaaacatttaagctccatgcaaacagagaccttgtctgacttttttcacttttgtatcccagcatatagcacagtggccagcacacagtagacacgcaaaaactatttcttgaatcaacgactctatgaatgaatggatgtataaatgagtggatggatgacaacctcaatgaacttagctttctgtgagattgtcagccatatgtttactgaactcacgtcacagggcttctgttccttaaacattccgtaaggcattgggcaccagcaaatgtttgctggatggctgcacgtggcaaaaaaagtctagctccaccaaaattccatcttcccttcttggggcacacagctagacaacctttcctagacctccctgcagttaggtggaccatgggcaaaagtgatacaggccatggccaggcttagcccataaaaacctccatgcagcctcctgcatgttcttcctacattggctggatgttgttgatcagacccaaggggatgtgtgtctccaaggtggaaggaggctttatccctgaatttccaggtggagtagagctccccaccatattaaacacctgcccaggacagatacatgagcaataaatgaatttaaatttgcagagccatggcctacccattctctgctacacagccagaaccagcttctctcacatgcccctgaatcctcgcacagtctgtctgtcctgcagcctcaacctgtgccaacttgcaacgtttccatgatgcctacagcccagctgacccaggaacctgccctctctaagcttgcagtagaacccaatctctgtagctcatagtccttatagagtctgtagctttttctgagatccatgggctagaatccaagtgggtctttaccagtttggagtcagggatcttttgagagaagataaaacacatggaccctcctcccaggaagaaaggagccacaggcccccgagttcaggcatagattcctagtgcttttgcccagcatggctcacctgacagccccattccaagcttaaaatgtccctgccagaaaagggccttgcctgttcaagctgaccctgctccctgagagatacggattgattttattgactcaggagccagctatgagcatgtccaaaatttatcagactagccttcatttgcagggcacttcccatggataagggtacaagcccagtgctcagaatcccagtaccactgcccagtgattctggttccctgccatgctcactcccttctccaatcccccatgctatcatggtacctcgagcaagtcctttccctccccaagactcagtttcttcatctataaagaggataataatataactaccccttagggttgctatgtggacccaggcagataatccatgcaaggcacctggcacagacctagggctagtattatctccttcaaccccctcccctgagagtcgaagtaggtatagtactatcatgatcttgtttctacaaatgaggaaacgaagaccgcagaaatgaactaacttgccctaggtcgtaaaccttgtaagtaacaagcctggactcaaacccctaaacttgactgccttccacagctgattggtactgggttgctatggaaacctgtagggcccagggtaagatctagtggaggccaagtgaggggtatgggggtggcagttctgttggtggtggggggagggaacactgacttaactccggccatccaaatacccacaattatacaattgagggtagccagggttaagtcagcctccggtaaaggagaaggaggtatgttcataggagcactatcacaacagccaagcgggagaagcaactccagtgtccatgatgggtgaatggctaaacaaaacatggtacatccgaacgacggaatgttattcagcctgacaaaagacgggaattctgacacatactacacagcatggatgaactgtgaggacatcatggtaagtgaaatgagccagtcacaaaaagaacaaatactgtatgattccacttatatgagacacctagagtagtcaaactcattgagaaagaaagcagaatagaggttaccaggggctgggggagagggaaaagaggagttagtacagactaaagggtcagagtttcagcttgggaaaatgaaaaggttctggagatggatggcggggatggttatacaacaatgtgaatgtacttaatgccaatgaactaactccacacttaaaaatggttaagataatgagtggtgttatgtgtatttcaccacgattgaaaataataattcttttaaaaggaggaggaggtcaaggtgttcatttatcacccgtggaccctgtctcgccatcccaaggaggaagagaggacgatcccgagtagaacgggctgctgggccacactgcccggatccccatctgcctttctcctgcctcatttccaattccagaattattcatcatcaaggagctgccagagatggaatgtgaattaggagctcagcttgattttgttttatcttattttcccccacgaggcgccgcctgagtggggcggggtgggagtgtgccgagctttgttgtgacttgtcgccaagcaaacgcggtgtcagcttccacgcaggaggctgagcatggagcatcctggggcctgtgcagaggatgcttattccaggaaataattacccgcgtgtcccttcaagttggcccaaaaaatagaacactcaggagtgagtgctgttataccttcttaattagtttcctcatttaacccgggtcattactagaaaggcattcaggctctggagacagaccacgttttgatcttttactcccgcttactcatgggcaatcttaacgaaagtcactcagcctcagtcttctcatctgtagaatgaaatgtagaataatgaaagtacctatattgtagggttgtggtgaggattgataaaatgtcatgtgtgaagggcttggcactgatatgccagtgtgtggaagctgactttgtgtcaccctgatcatcaccaccatcaccatcatcatcatcatttctattgggttgctttgtatatgctgacactattagacaaaataaagtgccggcgttcagtctactttctattgttcatctctccattcaaacatcccacttacaggtgccaaaccagccacacctgggggttggtgtcctcctatggtggccacaccagtgcatgatgtaggctgatctccacctcgacactggtaccatgagggagctcacatcaaggctggggcctgtgttcctggaagcagggtgatgcggcaattaacacaccagatctgagttcaaacctggcttggccttttaccaactatgagatcctggctctgttctttttaattatagtaaaatatacataaaatgtagcatcttaaccatttttaagtgtagtttagtggcattaagaatattcacattgtgcacatgtaccctagaacttaaagtattaaaaaaaaaaaaaagaatattcacattgttgtgtaaccatcaccactatccatccacaaaactgttttcatcttgcaaaactgaaactgtacccactacgcaataacactccatttccccctcctcccaggccctggcaaccaccagtctactttctgtctctatgagtttgactagtccaagcactgcatataagtggaatcatatcgtttttatccttttgtgactggcatccttcacttcgcataatgtccttgagagccatccatgctgtagcaggtgtcaggccattgtgtgtctgctttttaagttatgcagtgcagaaaacatcacagcttagagttgctctgaagatggaatctctatctaccctcttgctcagaccaaaatcttaggaatattccagaatcctctctatgttccacccccacacccacaccatcagtcagccctgctgagcataccttaacccaagcactcctctttggctcctgtgctacctccgtggcccaagccccagtctccttcacccggtgtctccaaaggtctaactgagctccctgattccactcttgcccccacagccactcttcacacagcagctagagggatctgttaaaatacaaattagagcatgtctctcccctgcttaacacccccctaaatcttctcatctccctttaaataagaatcaccctcctgtcctggacctgcagagtctccgtggccagtctctgctggtgcccttgattccttcctcaccatgctccagccactgtggcccaactttctggtcctcaggcttaccaagttcctacctcagggctcttgcattcacctatcacctcccccgagaggcctcccctcaccacacaaatcaaagaggcagaagcccacaggtcctctctccaaggctgtcttatttcaagtctttgcatgacacttatcacaactggctgtctttcccccctttgtttactgtctatcttccctactagaaggtacgctccatgcaagcagggagcctctctgactcattcattagtatagacccagtacctggcagagagccattgctcaataaatacttgttgaatgaactgacaaatgagcaatgaaaccatgtatacagagcactttgcatgctgcctggcaagacgttgtactagatggcagtcattattattatcatcattgtcatcataatgattaccctgggcctcctgcctcattgatctgcaaggctagacctcgctttaagatttgggacaagatcaataagtgtccaggactttctgtgtcatcaaaggagctggaattcatcaaaggggctgtgagtgaacaagtttcatgccttataggtctgtgtgttcaggcttaatgtcaatgagttctacacaatcctatcccactcccaggttggccaaagacactaagattgctgacatgagaaggtctaggaagggcaggcagggctggagctggaaggataagccagtgggaggagacagaaggggcagctgagagacagtctctctggacccacagtgactgaagaccgacagcaccatgaccatcaggacctgaaaggttcccagatctgggttccctgcagtagagacaccgaacagaaccctgatcctgccaataagcaattcatttatcaatagaccttccagatctcctgccatgtgcctgtactagacccattaactcagtcactgtgtgtgtgtgtgtgtgtgtgtgtgtgcacgcacgcatgtgtgtgtgttggtgctgctgctaggtgactgcagatgccaccctgaaaaaataatcaaacagctctttgagggatgcttcatgcagggtttccatggcaacgctttatgaaacagcaaggcgaactttggtaggctcgctcccacccccacgccttttcctgactgccacagggatcctcattccatgaggctgtgtttttccaaagcactgggtcctcttggctgtgggaccttgacttgattacttaccccctctctgcctcagtttcctcacttgtaaatgaggacaatgatagtacctatcacatagcattgttctgagaatgaaatgagtttgtaagtgtaaagcacctcttccatggttagtgtgataagcagaattctgaaatgcccctcagcatcccaccccttggtcccatctccacaatcccctccctttgggtgtgaataggacccgtagagatgatgggctgtcacacccatgactaggtaaagttatatggcagaggtgaagggatttttttttgcagacataactgaggtccctgatgagttgactttgagttaatccaaaaagaaattctcctgggtgagcctggtcaaatcaggtaagccctgagggtttagaggttagagacttgaagcagtagagacttttctgctgaccttgaagaaggaagccatcctgattttacagctgtaaggaaaccattctgccaccaatcatgtgaacttgagagaggccctcaggtctctgataaaacctcagccttagctgcccctggatgacagctttgtgagacccttagtagagaacttagttcagccatgcctggacttctgacccatggaaactgtgcggtagtaaatgtggtttaagctgctatgtgcgtggtgattttttttatgcagcagaaagaaagctgaaacagttagtgtttaagagatgttcatgcttgtggatatgatacccctctgcccacacaaggccctcgccatgctgtgttgtagctgcctatttatctcgactccctgctgacctgtgaccttcccacacaggtgcccagtaaaggtgagcccctgctcaattttccagatcagataacatgtgcttccctcgtggtcacagtgagatgatgtctggaaatagcaacctgctgatctaggtggagaggaaaggcgcctgctctgaagactatggatgcttctctttgtttattctgagcctagataaaaaatgccacagagaaggcgtgtggtgacacgtgtgacactgctggcttaattgccaatgtgagaaaacacaaaagcctgaaactccgcaaaggcagggatcgtgtatgcctcatccttatcaactgcccagcacagtgccagacacacacagatatttaagtcagaaacgagtttttgccttccatttccattcaatgtagaataaaacccaaagtcctccctgtgacctcagaggtgggcctgcgtgttctcgccccagcagcctctctgtcctcaggccctacctctaggtgaccaatttagtcccagtttgcccgggacatatccaggtttagtactgaaagtcccgtgtcccggaaaatcctctgtcaaagcaaagcagcacagttgctcaccctgccccctctccctcctgctgcccttgactccttccataggggccttcaggtggctcctcacacctgccaaactcaaagccctttgcggtgtttgcaaaaactcctggcttcacatctttcaggtctcttttcaagggtcagctcctccaggaagccctcccagactgccctgtcccatgtaatgcagctcaccactctctttccctgaccctgcttttgttctgcatgccatttatcccaatctgaaattattttttgattggcttgccccctggctgtctccacaccagaagtcaacctctacaagggcagcggctttgttgcattcctgctggatcctagcagcgtgggcataggtcaaatgaatgaatgaataaagctttgtctggcaacttgactttcggcccctttccaaatcctgatccccacgtgacagaagccctctgggtctcaggaggtcacaatggtccacagtgaggaccctaccctgctcctgcccccagcccactcttaccatccctggtgcctccagggctgtgctgactgtcgtcttccaactcaagctggcctcttgccccaccctatattcttcctcaggtggacctcctgggaatccccagaggcccacccccatgggatgggtctcggcctcagaccacctcctctgtgctggaaactgtctttcatttgtcagaggtttgagcaatctcacatctgctctgcccctggcatacctcactcaattattcaacacacaaaatccacgggaggtagattcgctcacacagacattatcagaccactgacttggaaccctgatgctctctggaagcagtttcttcctaattattcaataatttattttataactctgtggagcagtctgggccagccatcggggacagggacattgatcagacataggtcctgccttcaaggggctcatggtgttgtgggggagacagatgtgcagccaaacaattacagagagataagggggtgctgcagtggaagcctgtgccaggcaccatggaagcccaggggcaccgcacgcatttcccatggaaacagagactctcatttgccaacctttctgagctcaggaatcagacgcctcctctcccagctaacaggatctctctgggggatgagagttttgcatttcagtctcagtacttagcagaagtctatgtatatgatgtctttagaaagcgcccactgattagggacatatctggtttgagggcgactctggaattagtgagttattgggaggcagtgattcaggaagcatgtccatggcaggtggggtctgaagtgggccacatctcccatccttttcctgatccctgtgtgggcacagacaaccccaggccacaatttctgactccatctcctaccattctctattgtttctggtttactgggccttatatgaaatccaggccatcaatgcgctacagcgcatcagccccctcccctgccaatcccctacttgccagctgtagtcacactttccaaggaggagcacccacaactcatggcttggcagcctccctgcctggtctcaccattgccccagagccccctgcaggtgcatcagtgggtgtcgaaggctttgcagctgatgtcactgggcatcctaacaagggcctgtgcttcccccagttcaagaccagcctgatcccaaaccccacctctttctcacagcctgcctctgcctctaaaatcccattaggcctgtgtaagactgaggagctgcgctcactgggacaggagtcttctggccttgcatgccctgtcctgcttggaaggcaaaggaggccagtatctcagtgacatctgggagggagtggtaatgtcatggtgtggttccaagcacggttctggaatcagataggcctgggcatccaccttagctgtgtgactttgagaactacactgtacctctctgaccttcaggggcctcatcagtgagatgagagtgagatggtttgaatgcgagcctagtgagaggtgtttgggtcatgggggtggatctctcatgaaggctttggtgctgtcctggcagtaatgagtgagttctcactccatgagttcacgcagttgatcgtttaaaggagcctgaaatcccctccctttctctctttctccctctcttgccatgggacacgctggcttcccttcaccttcccccatgactgtaagcttcctgaggcctcactggaagcagatgctggcactatgcttcatgtacagcctgcagaaccatgaatcaaatcaacctcttttccttataaattgcccagcctcacatattcctttatagcaacacaaatggaagaatacagggagttattaagacttggggatgttgagaagattaaatgagatagatcatgtgaaaaacacatgtcacagacactggcacctagtaaggactcaataaatggtacactagctgtttgggatggatggaatggaaaacattccagcaaattcatgcggtctgggcaagagagaggatgctcaggctcctttgcccaggactcgtactgcagggccagcagcctcactcacagttgacatcttccttgcatgcttccctccctctgttcaggcttcatccatttttaatgatgaggagcatgtctgcctgaaagcggtccctggggagggggagcgagttctatatgtgggcatgttgctacttagggggcttgctcttacccaaaagagttgggggtttagggggccacagaaagacttcatttgagtaaagcatgtgcagcatctgtgcaaacacacatgctctgtggaatccagccactttcaagcaaggtcagcccaggttctcataggggatttgaagcaggattcacttgacaaacatctgatttacaaggaaccttgagggaaaaaatttattactgcttctctactccaatgccccaacagcttcccctcttactcagaggaaatgccaggtccttccaatggcctgcagggccccaggtgagttgcttcttccctgccttcctctctactccctcccttgctccagcctctggacctttgtacttgcagctccctctgcctggaataatcttcctcccccaaatcagcaagattgactccctcatatccttcaggtgtgtccgcaaatgtctgctgctcggtgagatcctctttaaaattgcatccagacccatctctccccacctctattccctgcttcctttttattcatagcatctaacatatcatgcagaacctgtaaccacactgtttattttctctggaatgcaaactcatgaaggaagagatttctgtttccttcattcttgtccttagggcttagagcaatgtctggtacgtagttggccctcagtaaatatctgtgaatgaatgaataagggaaaggaagaatgaagagcaggtgtcacctgcctgagagtgcagatcttgctgtcaaaagattgagagtctaaagcctgtcttcctcaccctggatccaacaacagtgtcttaaatgcaaccccagccacaccattctcctctcaaagccccttatggggcccctcacctaatctgaatacctacccctggcttatgcaacagtctcctcactgcatctgctcttctgcaccttgacagcccattggaatctctgaggaactttaaaatacagatgtctgggttctactcccaaagattccgatttatttggtcttggatgaggtctcagcatgggctctcttacagccttgttgaggttataattggcatatatttaaagtgtacacactttattttaacaacaaatatttaaaatgtacactttgttacattttaaagtatgtatactcctcttaaaccatcaccacaatcaggataatgaaggtatcaatcattcccgagattttcctctggacccaccccatgcagtccctttctcctctcctctctatcctctctccccaggcaacaactgatctgctttccctcactctcaactagtttaaaatgtccagaatttcatataaatgtaatcatacaggactcattttggtctgacttcttccactcaggatagttcacttgatatccatccatgctgttgcttgtatcagttccttcttgtttattgctgcatagtattccactgaagggatatactactatttatttattcattcatctgttgatggacatttgcattatttctagttttctgttcttacaaatagaaccactataaacatttgggtacaagtctttgtgtggacatatgtgttaattttccttgcagtaaagcctggaagtagaatggctgtgtcagatggcagatgtgtctttaacttttcaagaaactgccaagctgccaaggtgtttgtccaaagtggttgtgccattttgtcttctcacctacagtgtacgagagtctccctgagggtgcagatttttaaaagatccttgggtggttctaatgtggggttggggattagaacaactgctctaaacagtaagatctttgagattgaagtggtgccatggagtggtggagagaaggcgctgcagcaagactgtccgggttcaaatcctggctctaccacttcctagatgtgggacttaacctctctatgtctcaatgtgttcagctataacatggagatgataataacagtgcctgcctcacagggctattgtgaagaaagaagtacatagaatgtacttaaatcagcccctggcacatgatcagcatctcatccatatctgtaattctctttgaatctctgcactcctagtccccagtaaaacgtgcttggcacatgttaggctctttggaggtaattgctggatgaatgaagaaataagcaactggaataggacaagggcagaggttctagaagccttaagttttgtatattccaggtttctgacttgttttgagataattttaggactcatcctcccactcccaacaagacttctgcttttttgtttttatttctgaggatggggaccccaagcctcttctctccttctgatctgtccaggcagatggatgcacaacccctcccatcatatgaaagcccctgctcccagaccccagaagtgaggccttcctggccctagatggttgaggggtagggcgctgcagcactgggagttcaggtttcagcaccaggtatatctggctttatatcctgactctccccttaactatcagctgagtgactggggacacatcactggacctctctgtgctctgtgtcctcgtttatgaaatggtagtgctcataacacctctctagcaagactatagaggatcagatgagaacttgcatttagcactgtgacaagtagcacatggaaagcactcaggaaactcaggaatttactattcttcttcacacctcaaaggtgcagaggcagagggctgcttggcccaggcacctggactgactctgtccctctaggttgcctcaaatcatcaagcttccccttggtaaaccttatggagcttgaatcaaagtcacccaggatggggttagaattcttctctccactcatcctcttcccctcgaccgtggagtgaagaaggccctcctgcttcccactttccacagagggcctcttgggggaaggcctgataaagagcttatggtgatgtgtcttccctgatttgcagggcctcatcattcttgtcattcctagctttataatttcactgtctggctctgaaattatgcaagagaacaaatgcatgccacacttagtgccataaacacacaatctccaggttcttgttgaagggtcctcttgggtgctggtgaccctctccatactttcaagttgctccagccaaggccacggggtaagtgtgatggtgaaggatgcccttgtgcctcggcttgatgctgggtgctatcaggaagtgctccataactggggtccttgccttctgggattctcatctaatgctacattgatattagacatctaggcacaacaaccctctaaaaatacttcctgtctaccagtttattaaatacaggtaagaatggctacctaattttcagggcacagtgctggatgaaaatgcagggcctctttttcaaaaaatggttcagaatttcaagatggtcatagcagagcataataccatgcataggttcctcggtgacctgtgtgacctcacagtttgtgaacccaggaagctggccctgaatgcggatagccacattagaagcacatcctttccataagccatatgactggcaacagaatgaatgagcaggcagagtcccttctcagggaatcacagtctaatgcaggatgcagagacgggagaaaccagcagtaagcacagcacagggaataagtccagtggccaaggaacgaggtggaatggcatgagcttagtggaagtagctcacctgctctggggagacaagggagaggtcagagatcacttcccgtaagaaatgatgcaagacccaaatcttacaggacaggaaacctacatggctccctgaacttccagggagtttcctaatccaaggagtccagccttgagcctctggtcttgactccagattctgccagcccaccagcagtgaagccttcttgactgcaattctaggccaaccttgatctcacctgcccatccctagaagcaaccatgaaaattttctgccctgatggttgcaaatccttgaaggcctggtctacataaagtagatctttgatccaggacgtaattcccaattatgctgaggcttaaatgggaatcacatgtgccaggaggctggcatgtgagggagacactcagctagtgaagaaaccttgttgaccttctcaggatcttgggttctagggggtttgttgttggggcttatgtggcaactcctgtaaagtgataagaatcttcattttattgtgaaaaatcatttcccaaaatagagccaactgcccagggtggtgatgaaactgaaaagtaagcgagggagtctaaggaagtaatggtttttagcaagaaaatagaagctgcgggtgaattaaggagtggatgttgagtttgatggtggctctgatttgcaagtgtttgaaaacaagaaaaagatgatttatgaaatcatttcagcaagtgcttcagccagggcaaaaattgcttattgagtgggaatgaatacttttgtgacagctaaaaaggcggttgagagtgttgtgagtatatgcccaggaaacccatgactctctgtggaaatgcgcctagacaacagctgggagccacgtcaacatttccataaagcaccaggtggtggaggcagtcctgtggctgctgagctgacctttaagtacgagaaaaggtttaaacatttcgcaaacgttttcccttgccacaggagaagttaataggggcgtggtattattattcatcacgattctatttagtcttagaagctttagttaaactccatgcgaatgtgttggtcataatgatgtggggtgaggtagaggagagtatattttagtggagaattgattttaatattttataaatggctttgatctcatatttatggaatcattaaaggtctgaagaggtcaccaaaacactttttcttaagtacacacttcacagacttttttttttaaagcggggggtggggggtagtctataaagatatttgaggatctgggaatgtcaggttctcaggatatgcctggcttgaatttcaaggctctacacacacaggtagacatccacaccccagcgtgaacaaatgcatgtacactcctgtttaatcgcccagcacacctgcacccacaggtgaacccaggcacaagtgtgcacaccctctttccctacaccataaaggtatctctattgatttctttatctccgtagtgatccacgtccccctctgcactccccacatcaaatcccagccaaacgtccatgatggtcacccaacaggtgttctagaggtatcatgaaaaacaatacattaactctttgtaaccaggaagtcagggcttccatctgggagggaatgcctcacggggccttcccgatgagagtagggccaataggtttggggggcctcactcggggcaatgggtctctgagaagagcccagatcacattctttgcttcagttttatttgcactttctgacctccagtctgtgaagaagaacctccacggggcaggataaaccttgagatgaaggaaggagggcttgtctgaagagccccatcctctagggtaacagagagtcagaaggatgccatgtcttccttacatggttttctgcaaggcggtcagaaaccacagatgagatcccatcactgcaggagtattcttagatgctaaagcatggaagctgcccatctccgcgactattttcaacccctggctaactatcactggtcagccttgccccatgagcctagtggtctcctctttaggaggaagatgagaagcccgacccattttccagcctggccctgtcatagtcccacacttcggggagcctgtctagaaatgaatcaagctggttctttgagtcatgttaggtgagttatctttgcatctcatgcttccttaacttagaactcacatgggagctggggtgagtcttaagcccgctaacctcttgctgtccatctttagagttttttacaaattccaggtggcagatggcccccaaggtgactcccaacaatcctctagcatctggtgttcatggcttcttgtattcccatcccctttggtatgagtgaggcctgtgatttgcctctcaccaacagaacatgaaaaaggggatgggatgtcacccctatgattatgctacattgtgtaagactctgtcttagcagattagagataagatctgcttgcaggcttgatcaaggaagggtccatgttggagatgccatgtggcaaggaattgaagttggcctctgggatgaaagggctgcctctagaacctcagagtggcctccacctgacatccacctgtcagacacctgaatgagcttggaattgaactcctcctccagatgaaaatgcagccccaccatcacttgacagcagccttttgaaaccctgcactgaggacccacaaggccatacccagaatcctgacccacagaaactgagaatgtacatgtgttattttaggctactgagttggtgacaattttataactgtgattaactataactgtgatcgttggtaattttgataatttattgggaacaataggaaactcatacacccagcttgttctgggactttaccaccttgatgctactttttcaggcctctgctagccttcaaccttgtcagtcacatgtcccccttggcatgttctggacacatcctgtctgttctctagctcccaggagtaggtcctgtaagtcactcccagcgttgttcacttagaggtgatcattgaaacggtgggagtcagtgagatcataggagaaagaacatggtcagagaagaacaaaacaaggaccaaatcctggggaatggccacactgttcaaggcagctgctctgaattgaaatgtgctttaagcataacatacacaaccaatttcaaagacagtgtgaaaggaacaatgtaaaatattgcattttacattggttacatttttaaatagtaatatattgaacagatggggttaaagtatactactggatttgattcacctgtttctttttcagtcttttaacatggctactagaaatttaaaattatacacatggctcacatttgaggtttagatcacatttctactagacagtgcgatggatggatggatagatagacagatagatagatatagagattttgaaattatttattgcgtagttacagatgccatgcactatgctaagtgatttataatactatctcattggaccctacctgcagccttgtgaattaggtattattatttccattttacacatgtgaaagttaaggttttgagagttaagtgactttcctgagatcacactaagaattaatgaaaaggcagaaattcagtcagtcccatctgactgcaaagcctgtgctcttagccactgtgctggctggctccttagatgaatgaatgaatgagtgagtgagtgtgtatgcttcagattgtaagtggctttcctcagatcacactaagaatccatgaaaaggcagaaattcagccgggcgtggtggctcacgcctgtaatctcagcactttgggaggccaggtgggcggatcacctgaggtcaggagtttgagatcagcctcaacatggagaaaccccacctctactaaaaaaagattcaaccgggcgtggtggtgcatgcctgtaatcccagctacttgggaggctgaggcaggacaattgcttgaacctgggaggcggaggttgcagtaagccgagatcacgccattgcactccagcctgggcaacaagagtaaaactccatctcaaaaaaaaaaaaaaagaaaagaaaaggcagaaattcaaaggcagtcccatctgactccaaagccactgtgctggctggctccttagatgaatgaatgaatgaatgaatgagtgagtgagtgtgtatgcttcagatggtgaagaaaggtggaacagtttcagctcttacacaccagacctctaggcaatagcaggccccatgtggtgatggtgcccaagactcaatcccctccctctttttctccctccctcaggaatccctgtgtccgcaatcgctaatcccaccctcattccagatcttgcccattgtctctgctcccgtaaagtgaggccagcttgtgggatctcaaagtgacatccaatggcacccaagcctgagctcaggcctgggcacccaggagcagatgatactacaggtgctctcctggcacattcctgccccccacccttcctggcaggaaagatcagatgcccactcaacagggcagctctccttcccagcccgggccttccccagaagggagatggcttcctctgaggctcatccccagccttcagggcctacctgagtccaggtgcgtgcagggacagggctgggcccctggggaggggcccctatgtccatatgtgtccacttgctccctcctgcttccctgagcctcagagcaggcaggtgattttccaggtcacttaactggtaagtggcaaactctggatttgaatccaattctgtgtaacccctgaatgtgtgctctgtttaccgtaacccatgctgcctctctcctcaaccaaccatgtgcattgttgcttaattccctctgcctcagtttcctcatcagtaaaatcaggatgataacaatcaggttgctgggaggattaattggggtaatgcatataaacagcttagcacagtgcctggcacaacataaacactcagcaaatgagagcaatgatcattactagaaccattatcattatcattatggcagcccttgcggtgtctgccgggactggtgggaagtcactagcagttaacaggatctccttcaacgcttctggcacggccaaggacaccttcccagagagcaggactcacgattaacatgctgcagatgaacaccagcctttgtcctcccttgaggccccacctgggccacattagctgtgacctctagactccctgaggccggcaaaagtgtctcatgtgcatgggtgagccagtgtggcggcttcatggaaatgcatgcccgcgaccaatcttcctccggccttatggtggggcagccactgggtccagccctgacactgctcacaggctgggagatctgcagggcctcgggaaacatcgtgcctggctcaggtctttcccctgatcctggttgcttcagcttttgtgcaaagccaggcacattccaatgtcttttctgtgctgtgcgtgggtgagagcagagccagcagcttccgagcagctcttggagtcacatcctcgtgaaaggacagagctgggttttccccgtggagcccagtggcaagcagctgattacttctttgccttctctgcaagcttgggagggtcatgtgggattggttcaagtgccttcggcaggttgggcgggtgcctgttttgggaggtgggtgagagggggtgcctccaaggaacccaaattctacctgacttcaccctcccagcttggttcctcagagtgccctgggagccatggagagttgacgagatctattcctgtaagtcttccaaagaggcaaaggagaatttgggtggttagagagaggcagcacaactgactaaatcacagctcgatacttcttccagcccaggagacaaatacttataatattgatatttccatcactggtactccctagggaagctagtcctcaaaggactgctgcgtaggaggtgaaagcattgctaacattcacgacagccaccccttaaggatgttccaggctggggcagggaccgcgggagtaggtggtgggaaactgcagaaacggactccctggggacttctggacagcagagggggcagtgggatgaacagggcttgagagaacagagaaaagaaaaaggggaatgtggcccagcccttgctgtcctcgaggctaagccaggtccctgtgatactttgacagcacagtgctgctttgtggctggtgccattagagttcatagtaattcatttatttgatgattaattgattcatagttttagattcaaccacactgtggcaggcttaataatactcctcacccccacccaaagatgtccatgccctgatttccagaacatggaaatatgctgctttacatggcaaaagagactacagatgtcattaagttaaggatgaggtggggaggtcatcctggattatcctgatgtgtccaatgtaatcacaagtgtccttataagaggggggcaggaggattggagtcagtaataggagctgtgaccgtggaagtaggagatcagagtgacgggaggacggggccataatccaaggaggtggcttctccgaagctgggaaaaggaaggaaacatattctcccctagagcctccagaaggaatcggccctgccaacaccttgactgtagctcagtgagtctgattgtggacttctggcctccggaactgtaatagaataaatctgtgctgtcttaaaccatcatgcttgtagagatttgttacaaaggccataggaaaccaacacacagaccacgacctgcacgagcgcaactgactcatctactgatgtttctccaaggctctgcacaggacccgaagcagcaggatgagccttcacagctaaaagactatgagtctccattcaggcttctcccttgcagactgagagacggctgaggttcagagagggtaagccatccatccaaggttgcccagttgcaagtaggcctcagcctctgaccccaagactcagctcccagccacccctccagacccaggccctgtctttctttaaccctctcctcaaccagatcccaggcctggccgtgccagaatccagccctgctaggatcctcccctgcccacactatctgccttaggatgtgctgggcctattgcccagcacgctggcatgtccccaagctgtgttgacagcaggaagaacactcaatgccagtaagcagactcggaggaggaggcagtgcagacagctgagaggggacattgctacccactagggaggccaaggggcttcctgcacaggagatggggtctgaaatggaatgggagaagggtcagcatagaagctaaagctgggttccattattcactcattcattcagatattcattgaccccatgcactgccccaggctttgcagaccctgagggggtcctgggttgaatcagaaaagcttcctgccccaggggactcccaggtcagggtacaaggtagctgggtgtgataactgcattgagaaggtgaagtgcacctggtgagatgattcttctcttctctttcttgcctgcctgttagtgcaggaaaatgcacttgagggtagaaggagcctaagaggaatggccatgcaccctgccctttagcacgtaagagctggctggggagacaggactcctacacgagaaggaagagcccccagggtgcctgagcagggacaggctctctaggcagatgcactgaggagaaggtgccttctagtttggggaatggggagtgaccagggcagagctcaggtaaaagcctcagtctttataggaaagacgtcaacacactgagaggggtaggaagaatcaacggatgaatcagaataatgggctgctgcagtctgagcagaactgccctctgctcagccacatggatgtgctggccacttcccttcttctgctgcagcccctgcaaggagtctgcagagctgacagccctgagcaatggcctggatgctgtaaacacacatcattcatttgcctaccttaagggcagcttgtaagtctttctttgtgtgtgttttcatcaagaagtaatccttacagccacgaaaaatgtccaataacatttctctcccttggcaaacatccccggtatatcaaaggctcaaatacacaatgcagcggctcacagggacaggtgttggagactgctttatagcagcctgaagaactgtctgttggtcacatgggctcgcacaaatctcacatggttccagaaactgataacccagcagcatacagaggagattcctcccactgcgtgctcattctgcctttcttctggaaatgctcctctgagccaggcatagggccaagcactagggacacagacatgagccagtcaggctgtctgtccccaaggagcaagttttactgaatgctgtgttaagtgctttatatattgcaaaagtcccagaaggcactccaacgatccccattttacagatgaggaaacaaacagagacctagagaaatttaagtaacctgcttgatgtcccagggctagtcagtggcagaggtgctttgcttgcatggaactgtgagtgtcccaaagtcagaggctgagagttactcatctcagcacagggctcgacacaaagcacactgcaggagaatactggcaagtgtttgagcatgagcttgaaagtcagataaggcccatctcaggatccaattcctacattgcacattaaagcctccaagtcccacagaacggaaggagtatctccaaggaatgaccttcttaggactggagcttcctggccccttctacaagagcaaactcagatgactgcacacttttcatctttgagtgtccctaataaggcaaatgaagagggtactctatggacggaacagccaccctgagtcagccatgatgccagatgcttaatgcctccacccagttcacctcacaacactctgaagccaggcactttccactgcacaaagctctgctcagactgcccctggctgggcaagctcccaccctttccttcaggaggctggccccaggctaggtgtaggaaggaaggctgggaagaatcagtgtgtcactctccagggtacatgcccagcaccagagggcctggcttctgagggcatccagcctacactcagacctcctctgcaaggtgcagtggatccaggggtacccctcacttagactggagtccacttactgtaatcacaagggctcctgacagttttagagtcatgtatttattttctgtctcctgggttagagtacaaacagacttttcttcactgctatatccccagtgcctggaacagtatcagggacataatacacggtattatttaaataaatgaatagatcccttttagaagacattcagtagatccacagatcctccctctcccaagtgtacacacacacacacacacacacacacaagtgcataaatgtcccaagtccaccgattagggaatctcacacaaagtctggccatccacccagattccttctgtaataagattcctgacagccaaaacctggtttattccaagcagagatgatgctacacaggtgccatcgaaaggaaccaccaggggggaggggagggcctcccctctgtagcaggtgaagggcatctggaagctggtgcagcctggttggactccactgacgctccagtggcctgtgcggatgctctctgtgtgcatggctgtgggcctgctttggggatgtcgaactgaatctgagctctgcttccctcttgatagggagaaacccagcaggtggaaccagtgtattcctcgctccctccaccattgcctctaagcatggctaatgagtatatttgacctcacatgctcaccccagcagctccacaaacgtcactcaagatccctcctgacatccaaatgcagggggcaccgcattttaagttaaaagttatatcctcacatatttcatttctctattctcaacagcaacttgctgatcattcccaacccttcgatgctgagccaagggacccgggttgctgtctcacctgagtagaatgtgctggtttgactttcagagctagctcaggatgtggatggctgcaggtctccattgccatggtgagacacagaaggggagctcatctgtcttgcccaagggctgtgaccagggccagagtcatgcacaggatcaggggcagcagatgattgaggacttggtaaaatgggtttaaacaaaggctgatggatccaaaagggggtggttggggataaggaaacaaaatctcagaacccacctggggattcccagcctagggtgtaactttagccccggggatctggcctctggcttcatttctccgctggctccaacccaccattgcagcactatctcagcaggatgtgggatgccctctctgccttcctggagcaccatctgacccagggaggttcacggaatctactccagctcagagcagggctgtggatcaggaatccctgacccaaggcagaagcaatggaggcaacaccaccagggcatgatgcgagtggtccaggagtctccttattccaaatctttcccgctgccccctcaaaatgcctgagattccaccatcagagaaccattcttttgatgaggcctctggctctgccacaatgtgacactgggcaactctgaactgctctgaccctcatttataaggtaggacactaatacattcctctttgggctgtttgaaaagttaaatgaaggaatccatatagagttcccagcatagttcttggcatatgaaagctgtttgactggtattggttctttaccccttccctttaggttcttcaagtgtcgtggagttcagagcttttccagaaaagaagtggcagtttatgggatatgggggagggtgtaggggaaacagaggacagaaattaattcacagcacaggctgttattcaagcaaagaggcagagagggacaaaagcaggtaagaaagttcaagttaggaggagaggggtaggaagttagcaagaaaggatggagggaaacaattccacctactctgagccagatcctgtccagggtgctggaggtaaacagctggccgggaatgactaccttcccatagaactcccagcctggcagcagggctgggtggggagtgggcagatgggcaaacaggcccagtgaatgttggtggtgagggaggtgagtgggcaagaataggaccctgtgggaacaggagattcaacctcatgaatgttcagataccctccctattacccagcaaactctcctcagtccatccctccatcagggcagaacaggaccctgtgggagcaggagattcaaccccatgaatgttcagacaccctccctattacccagcaaatctctgtccatccttccatcagggcactctctcttaggtctcacctgctcaaagccctcagtggtgctctgttgcctgcagcctagattccaagcaacttccagggaccctcaggacaccccatgaccaatcccctgccaacccctcactgcacctccccatcctttactgcagcaggagcactgagctgtgctcttgccagctcctgctcctgctgctgcctctgcctgagatgcccttccctgacccaacccttccacatgctgaccctgtggaataagagcccaagaaacagaatctacagtggtgggactggaagcctcaactcagatgtcccctctccccagccttcctcttgggtcatttgttttttggtcaggacataaaaggatataaacattaaattagaaaaaaatcgcaacagcttctataaactactgaaagagtcaacagaagcgggcaggggtcccggtcggggctgacacgattcacaatgtgggaagggcaggtgtgaggtggagcacacctctaaggaggactaaggcttgctgagagctcatctgggccagccctgtctaaaatctttaagtgtgttgtttatccttgcagcaactcagcaaggtggagactttattattcccattatatggatgaggaacttgaggaagaaaaaggttaagcaattttcccaaggtcatgcaggtactggggaaggagatgagattacaacacaggaagtctgactccagagcctgtactcttggccccaccacattgagcatctcattatgtctggtgcttcaaattttgtctttgagaagcagctgggtgtaatgggacaatattctattattcaacatacaagtcgttatttcattcattcccaacttattatttagcaccgtgttccaggctctgtgaatctctggggattcggtgctgagcatgacacatcacagagggcagacaggtagacccgcaacccactccagggcgagaaagatcatgatgagctgtatagacagccgtgggagctctgagaggaggcttttcagccagacctgcagggtcagggtcaggaagggcttcccgggcagagagaggtctaagtttgacacctgaaggatacgcaagagttaatccagagaagagagggaagagtgctctaggtggagagaacagcagatgcaaaggccaggagaggacaccgtacctaagaaccctagaaactcagagtggctgggatgatgcaaggatgcttacgagccacctagccctggcacagacccttctgtctctcctgaccccgctgcatcttcatcctcctcattgtttccaggaatgagagctaacatttattgcatgtctatgatattccaggcatcatactaagctctttgcaaaattatctcactaaatcctcttaacaactccaagaagtgagtactattgccatctctattttacagaagaggaaactgacgcacagagagttaagtaacttgcccaaagccacatcacatagtcaataagaatcagagtcaggatcaaccacagccatctccaccctcccatcattgcaggtacatatacctttctggaagctcctggacttgaactccacgtttctgttgctttgtgtgcccatctgacatgctcctgtctcacctgctggtttactttgcccttctctgtctttctgaggttctccttgcccaccccatgccagatcccctgccagtgagatgcccagggtggctgtgcccagtaggacctggccccgtcacagctgcccaggttcccttcctccttgtgtctgaagcagggtggagtaggggtggttgtcagtgcagagagccagacaagcctattttgtgttttcctagcaggtttcctatggcatctttgaattaatgggacagagatgaaggaggcatttcggctaccatccaaagcgtcgtcaacctgctgagaaatagccctgccccttcctcctactgtgggtaccagtatccaagggcactacaggctcagtgcttcccaagcctcttgtccagactggctggcagagcgactgtgaatgccaatccatttgagaaacagactggtaacaagagaccctttctggctttgtgcagagttcttagcccacagagcctaaatcactacaagaaaggaaagagaagggagacagcagccattttgttgccttcactggaaaagcttgtgtgtgttttatgtgtgtgtgtgtacttttgtgagcctgtgtgtctggtggtgagtgtgactggatgtctcagactatgatgcaggggttaagagcagggaccccagagcccatctgcctgggtccaaagcccagctctgacttactagctgtgtgaccttgggcaagttctttaacctctctgagcttcagtttagagcaatgccaggcatctagccagtgctttataaagattgactattgttatttttgggggttttagtgggtttctgtgtctgtgtaagtctgggttctgtgcccgctttagagatctgagattcttgtaggcaacttggtagatagaacaagtgtcctggaaccaggggagagccttcactgtggaccctttcctggccaaggcagtgggcaccagtggccagaaccctcaactcttatctggggctgggactctggaacctggccagttacaaaataaagatataaggaacctcctgagaagtttcacagactcagactatcccacctggcatggtccttagggatcatcttagaacccaaatccctctctcataaatgggtaaactggagcctcaggaccactggctccttccttgctgttatctgaggtaggttgcaggaagggtagctgtcagtgcaaagcactggcaggaatattttgtcttttcctaacaggtttcctagtaggtcaggtctcacagtgaaacactggctgaatgaaggaaagaatcaagatcttctgactccctggagagacaaagaatgattcattcatatacatcccaagcactaacaagaaagggatgacttgttccagggccaggtacacagtaagcactcaattaagacagttgttttattttcttcgcttgtgcctttgaggaactctctgtccactcaaccattgctccagttcctccattcatccttccatccatctcatatttatgagcacctactacgtgtcagaccgtggactaggtgctaagtccctgctctctagaagattagagtctagtaggggtggtaggcagtcatcagaaagcccaacaagtatatgcaaatgctaatcattgttctcactgaagatgatgaaacgaaggaaaatggagaaggataatctgatcttgtctctctgataaagtggtattggaactcagatctgaaggatggggtggggaacttccagaaggagggcctggcatgtgcaaaggtcaggtagtgggaggatacaagcctatctgaagaactgagagaaagtaacatggtggagcatgggaggggagggaaaagttacttcagaatagaccaggcgaaccagtcttatttgtgggcccgtgagagatacccctggggtctcttgggcacacttctgttgggagagaggagaaagtgcagggacccagtattgcagaggcagtgggtgatgtgagtgctccgaagctcttctgctccccagatgcagcctctgctctggttgttttgcagtccttactcccggttgtttgcagttcaacattccagctatttgcactcacttcccacttatttgcaggccttatcctcaggagtgtgcagtcacagccccagctgttcataagcactttctcagctgtttgcagcttccaccctcagctctgtatagtcccttccagctgtgtgcagttgccatcctcgttatttgcaattttcatccccctttgggcatcaggtaaggcttgctcaagattggttctaacaacaagactcattactagtagcttataattgagtatctgacttgtgctaggggctgttttgagtacttttacctatactttctcatttgatcgtcataacaaccccttcatttgttcatcacgtatttccgtcctactctatatctggccctgggccacgcactgagtatacagtagagaccagaactagatatgttgccactctcctggagctttcagtctcatgaaggagacaggtgctcatacagcaatgacactgccaagtatgtaatcatagagccagactggcccatgagggaagcaaaggcatttgggctggacaggccatcagaggagaacccctgggacaatgagtctggagctgagagctgaggaatgggcacagtgaggttctgctgggatggggctgcaggataagaagcacccccaggtggaaggggtcccctgtgcagatgcttcagagggagggctgagaaagggcagagagggcagtatgggaggcctgtggaagtcacactgggtgccctgatcagagtggctgtaagtctgctgatttgtgccgagggcatgggtgaaggcagagaaggcaatttagagctaccatagctgtccaggtgagacaagatggaacctcaggctagtgggtgacaggacggtgaagaaaagtggaaagtggacagatgtcagaaacattcagaaggcaaacagaagtgggtgatggagagatcagtggccaaaatgactaccagttttcttggggggctactggatgaacagacgttccatcctctgagctgggagcaacagaggagaaccagggcgggaggaaggaggagcaagatcacaggagacattgagaaacagacctttgcaaaggggctgcacagtggcacagtgccacagtgcccaagccctgggctctgaagccagactctgtgctccagtcctgaccctctaccttctagtagtttgtccttgagaaagccatttaaccacaccgtgcttcagtttcctcattagcaaactgtggaagggaggagagaggttatcctgaagcttcttggactgggagtattttaaatgagttgatgaatctatcacaggcactgtacgtccccagactctagcttagtatgtggcacatggtaggaactcactcaattcatgttgaatgactgaatgaatgacggacctgtgaagagactcctggaataggttataggagacctgccagttggtggaggaaaggatatccctggcagagggagcagcaggtgcacaggcagagatgaccgcaagggcatggcaccctcaaggcgctggatctactgtggccttggtggagcacagggcacagggagggctggcaaagatgtgggtgaaggggtaggcagaacccagctcgtgaaggctttgtacatccaagacatttggaccagaccctaggagtccaagggagtcttgagggactcagaacaagggatggcagggctaggagcccaagaaggatgaattaaaggggagtgagatgaggagggcaacacttctaagaaggcagggtgtgagcagagacctgcaggatcaggggagtggggacccagctgtctacagatgggctgttacaggaagagcctgattgccagagcctcccattgccagcccagcttctcagacactcccttaggggtctacagttatgacaagggccctctgcagagggagactggaggcagggagctgcttagaaggcagtgcaacaatccaggtgggagatggctttttaaaaaaatatccgatgattattttttgagcacttagcagatgccaagaacttatttatggcctcatgctcaaggatgtgggcaatgcagcaggtctaatcacctgcctctcccctccttgccacctatcttggggcatctctctacttgggaacatttttccctgtgggaagttctagcgggcaagaagggaggaaagaactgacatcaaatccttggagactggttatgtagaaagtaatttcaaagagtctgcaggaatatttgcagatctggtctgtaatctgcaagacttcctcttcttggggacagacctggttctcacagaacgtctgctgtcttagtctatctctccctgtagcagaaggatgtctcggtggtcaaggctaaagtgagaacttgtgaagctgcaggtcacaggcatgctttctccccagcccatcacccatcctactacctctgaggtcagggacatcagaggacaggatctctgtaaaggagagaaagacgttttgaggaagcttgtttctgtgcatgtattgggcagcctgcctccctgaagctgttagccgagagtgaacattaacatctcagggcagacgaaagacttgcaccataaccaggggtgttatgaaaaatggacataggccgggtgcagtggctcatgcctggaatcccagcaccaagggaggccaaggcaggtggatcacctaaggtcaggagttaaagaccagcctgaccaacatggtgaaaccctgtctctactaaaaatacaaaaaattagctaggcgtggtggcgcatgcctgtagtcccagctactcgggaggctgaggcaggagaatggcgtgaaccctggaggcggagcttgcagggagccgagatcgcgccactgcactccagcctgggtgacagagcgagactctgtctccccccaccaaaaaaaaaaaaggacaaaatggacatagcttgggccttcccttactcctgagtcagaatctcatggaggaagccagggaatctgcattttgacaagctcctcagtgatcctgatttagactaaggcagtgcttcttcaacagtgtagagatcacttgtggatcttgaaagtgcaacaggttctatttcactcggtgtggggtgggggctgagttctgcatttctaacaagctctcagggggtgcccatgcagctgcttctcagatcacactcaaagcagcaagacactcaagtgtgaagctctggtttccaaacttgctttttaagaaaacaaatccctcccaaaagaaatcttggtctgggtgcagtggctcacgcctgcgctttgggaggtggaggaagaaggattgcaggagttccagaccagcctgggcaacatagcgagactctgtctttacaaaaagtaaaaacattacccagatacggtggcatgcatctttagtcccaactactcgggaggttgaggtgagaggatcccttgggtccagaagttgaaggctgcagtgagctgagatttttccactgcattcaagcttgggtgacagagtgagaccctgtcaaaagaaaaaggaaaggaaagggaaagggagaagggagggagggaaggagggaaggaggaaggaaggaaggaaggaaggaaggcaggcaggcaggcaggcaggcaggaaggaaggaaggaaatctcacacagaaccccagaaccccagtgtataaaagaggtgatgttaatataaaagtattgcacaaatgggtaatgattgcttattataaaacctctcaaagaaaacaaggcagctttgatgaaggcagacgtgtggcgttaacggttcccattgctatcgtacatggacctcagaatccatcatattcaagccaagtgtgtgcagtaacgcaatgccacagcttcaaggcttcaccagcaggtcgatggaggggaagctgtcctggagggatggagccctgggctgtctccctttcactatggagactcaaaactcaggacttagccttccttccccatccaccccacccctccctgggaagtagtcacagctaaatttagctgggagctaggctttctaggggaggcgagagtgagagggaaactgtgaggaacaatgccaggcacactaattagtggtttggcagctggggaggacaggagggactgcggtgggccaggccctgaggctgcccaggctcctctggaggaaggcaggacgtagccacgtctgcagggcttggcagagaggtggaagtggtccatctgttgggaaggcatggggctggcttggagggtgcttgtaggaaagatcaagccagtggagtcgaaacgtacccgagtgtgaatcctggtgctgccacttgctcactgtgtgtctctaggtaagttgtttaacctctcttggctttggataaaaaagggacactcaatactttaaggaggttaagtaggataatgtatgtgaaagtccctgctccccagtagatcttgtgcctttgttttccctggctggaggtcaaggtccttggtgcactgccaagcttagtcctgctggtacaaacctgtgctccctttcaagcctccagtctatagagcggaggcctggaatctctttgatcgccccacccttagaggaatgcatggggcctcagtccactcgcaggctgccagggcacagcgactcatgttctggtggaaggagcagtcactctctgctctgagctgtttcccttgtccaacccctgagcatcagttagcaccctggatggagatgctccattaataagtctgactgccccaacccagggagctccttgagggcagaggtggcacctcattcaccttggcaccaccccagtccagcccaatgcctgccgcagagctggcagcagccaggattactagaatgacagcagccagttcctttcctctttacatatttatgcccaataatcccttcaccttgaagctttccactcagctccggcttctggggatacaaggctcaggcccttgcagcaacaccctcctacctctactctctcaatccatgtctttctgtacctctccagcgctgctgaaagcttgccttctgcaggaaatcctccctccttgggtaggcaggggaagggaagggaagctaacacgtaacatccttggcatagcaaggagtcctcacattgcccctagaagggatgtatccttgccatgcccattttacagctgaagaaactgaggctcagagaagcatgaaatcttgtgacagagcgagtaggtagagccaggcatccagcctgggcctgcttgttctcagtgccctccccagagctggctgccttcatgcttccctgccaggccatgactcagactgttccctaatcccagttcctctcagaacttctggcctctgtctgtgctgtatttgctaatagcttaaagtccttccaagtctgctctcctggcttcaaccccaagctgccacagtctctcagacagggctcctgactagcttctcttctccaaatgggacacctggagcgtaactcagggcactgggcatgaaggtaaacagacctctgtcagcatggactccagggctcctttcctcctctgttctgggaccaaggcacggacatgcagcccctgattgcaatgtggcacagtaggtgcaagcatctggaggaggtgagaaaggcagcatccttctcgtgtgtgtgtgtaaggcttgcaggaggggctgcagggtctgctggctccaggttgcaggtagaagatactagccatggccgatggcacagcagggatgggggcttagccaggcattggaacccctctgcccagaggggctaagttcatcaagtagccaatgaatgcacagacctttatcccccagtagaagacagccttgaatggtagactctggagacacacaggcctgcattcaagtccttgttcttccactacctaattccataaccttggacaattcccttatctataaaacaagtaatgataccccctatgctataggtatgttaaaggatattaggatcaactaacatttaccaatcacatggtattacactattctatgtgctatacacataccagataatttaatccgcataataccccagaaggtaaatttattactatcaacatttagcagaggaatatagagttgagttgacttgcccaaggtcaccctgctcgcaagtgctactgctaaagttttaacccagggagttgggcatcagaactcaatgtcctaaccagtatattaaacatttagtagcacgccaggcaaaagtctgacacagagcaagtatttgtttagatacctcccaggagcatctcttccatctctgctgtcaattataattcctctgtggataaattgcaaggcttgacctcccacccagatctccttcatgagcttcagaccttcaagtgaaattaagtcctagacatttctaccaggagcacctcacccttgccgtgcctccaaacagactcttcatcactttacccatgcactcacctattccagacctgctcttcctcctgtgtcccctaaaatcagtagcaccaccatgcccctgtgttcaagttagaaacctggatcatccaacattctttctcccagcccccacatctccactgctttaattcacacctgcatcatatctcacccgacctattgcaacagtctcctaggataaactctccttgtctcccattcctcactcccccaaatccagtagctttagccattcatggagctctcctgtctgcagagcaaacacttcatgtaccaagtgcatttaagacttttcttgagctggctcctgctgaagccgtaactcaggtccattcatttgttcatctctgtctccccagagtctagcgcagtgccaagcacacttactgggcttaatacataccttttaattaaagaaatgaatgaaggagtgaaatctgcgaaagtcactccctgctgtcagatgcagctttgtgagcagtggctggagtagccaggacatggaggagacccgagtgacatgtgatggcacatgagctctgcagagggcccttgtcacaactgtagacccctaagggagtgtctgagaagctgggctgggaatgggaggctctggcaatcagtctgtccccttaacagcccatctgcagagagccaggccctcacatcccccaccctgcaggtctctgctcaaacgctgtcttcttagaaatgttgccctctctgtttcattctggaatgtcctgccactctctgtttcctaaccctattttagttatctttctagggccaggtctactattattattttgggttaagttgttgtctcctgtggctaagccacggtctccatgagagcagggacttgttccactttattcaggactgatgcccagcaattaaaacaacacctgacatgtcacagaaactcaacaaatacttgttgatggaaaaaaaaaatactaagacaaggaggggatgctgatagggaatcaatcatgttgtatcggcatcttattcaaaatacgatctgctaatagccttttcaaccaatgatgctagaacaactgaatattcacacagggaaaaaatgaacctcaactctcacttcaccccatacacaaatattaacacaaaaggaatcatacaactgagtgtatatacaagctagaactataacacttccagaagaaaacaagagaaaaccttcatggctttgggacaggtaaaaatctctctctctctccatatatatatatatatatatatatatatatatatatatatatatatatatatatatggatgcataaacaaattatagtatattaatatatatgaattatatagaaataaaacacacatatatatgtaatcttataactcactaataagacaaataattcaatttaaaaatgggcagaaacttgaatagatgatttccaaatggtcaataaacaggtgaaaaaatgtttatcctcattagccatcagggaaatgaaaattaaaaccacaatgagataccaccacatacccattagaatggttacaatgtaaaagaataaagataccaagtttcagcaagggcatgtccaccatacatggctgatgggaatgcaaaatggtataactactttggaaaacagttgagcagtattttatgtaaacatacacttaccacacaacctagtaatttcattcctaagaatttacccagaggaaatgaaacatataatcacacaaagacttatatttcaatgttcattcacagcaggtttacttataatgaccccaaaccaatgacccaaactttcaccaaaaggatatttggatggataaagaaattatggtatattaataaaactgaatagttttcagcagtaaaaaaaatgaatgaactcctgatacacatgacaacacatgaactaatctcatcactgttatactgaaaaaagtcagacacaagagtatatattgtatgattacactgtacgattttgctatgtgaaactctaggaaagacaaatctaatctgacgtgacagaaagcagatcagttacctgcggtcagggatgggaggagaatgactaagaaccggcacaaagaaacttttgggggcgatggagatgtttatgtcttgattgtggtggtagctagatggatgcatgaacttgtgaaaacgcaccaaactgtacactccaaaatggtgtattttattgtatattaattacatatcaataagagtgatttaaaaaagactttgggaggctgaggctggcagatcacctgaggtccggcattcgagaccagcctggccaacatggcgaaaccccatctctactacaaatacaaaaaattagcctggcatggtggcctgcgcctgtaatctcaactactcaggaggctgaggcaggagaatcacctgaacctgggaggcggatgttgcagtgagctgagatcgtgccactgcactccagcctggacgacaagagtgaaattccatttcaaaaaaaaatttagactaggtatcaaaaaaagtgataggatgtagtagtaatgtaagatatgtagtagtcagaagtccaaagatctattcatgggctgtgagctcactcctggaaatggagttagaaccaattaaacagttatttaattggaattaatgaggattcaccccatttaaggtgatgagagtgttgcacgaaacacattactctcccctcaccccacactttctgcacgtggaaagcccggttctgataggcctatctcctcacactctttgctgctctggggctgtctcttccacaccctggggagaggctatgaagaggagaatcagtcaccccaaactcaagggacttgggaaaaacaatgggctcttctatcagacctatcttgatccaaacttcagctctgccaagtcacttgatctcttcgtaccttacattcttaaatctaaaaatctaagacatttaaacagtgccagccttaggttgaggccaggggtgagcctactgagctcacccagttacctcctaccctttcctgtctcctccagattagggttgccagataaaatatacaatcccagctaaatctgattttggataaaaatgaataatgttttagtgtaagtaaatattgcatgggtcatacttataatagaatatcgtatgggacatatttatggtaaaatagtgtttgttatttatgtgaaaatcaaacttaactgggtgttttgggtttttttttttttcctcttttttagagacagggcctctgtctgttgcccagactggagtacagaggcataatcttagatcactgcagcctagaactcctgggcttaagcgatcctcccaagtagctaggactacaggcactccccaccatgtctggttgatatttttcattttttgtagagacagggtcttgctatgttttcccagctggcatggaactcctggcctcaagcaatcctcctgcctcagcctcccaaagtgctgggattacaggcatcagccacctcccatggctgtgtcctgtacttccaattggaacatctggcaacctgattccaggtggctcctgatacacagtccttgaatctttagggttccagagaacactgaaaccttttagtttaccgctgtacatcctacatgaacttgaaagtgtgggctagaaaatcttggaaattcttccatcgaaattgagaagagaaatggaacaggtggagtagaacccagcaacagccatagtcataggtttccctgcctcagccagctttgcaacaggatcaaagtcagcttactccaggagtgcatgcaattaaaaaatccccctgaaagggagccaaaggaagacacggtcttgctgttctgcagaggaatactggatctggtgaaacaccacggggagtcagaaaacagctctaggcagagggaccttgggcaagtcatttaagctatctgtctctgactcaataaaataggcctcaaaacaaacttaaaatacaaattacagagtaggaaaagacagccataacatatataatggacaacacagtgataccaagaatatattaagtggtccaagtcaataaaaaaaaagcaaatacccaacagaaaaaaaatgggcaggagatatgaacaggtaatccacttgaaaaaaaaatcacaaacacaaatggaggataagtatatgaaaagaggcaccgtgttgctaatcaggaaaatgcaaatcaaaacaatgagatagcattatttgacaatcagattggcagaaatgaaaaagcctgataaaatctaatgttgggagagggtaggggaatcaacccaggtggttagtgggagtgtaaacaagctttggagaagacagtctcacaataacaaaattacagcccacatagtctttgatgcaaaaattccactcctcactttccatctgacagacattcgtatataagctcataaaagtgcattgatgatggtactcatgacagtacggctcactgaagcctcgacctcccacctcagcctcctgggtagctgggactataggcgtgcgccaccatgttcaccaggctcaccatgcccttctacttctttgtatttttagtagagatgaggttttgccatgttgcccaggctgttcttgaactcctgggctcaagcaatgcacccacttcagcacctcagcctcccaaagtgttgggattacaggcgtgagtcactgcacccagccctagcatggcttttttaacagagatcactggaagcaacttcaatgtccatcaataaaatgttagataactcggccgggtgtggtggctcacgcctgtaatcccagcactttgggaggctgaggtgggcagatcacgaggtcaggagatcgagaccatcctggctagcatggtgaaaccctgtctctactaaaaataaaaataaaaaaaaaaattagccgggcgtggtggtgggcgcctgtggttctggctgctcaggaggctgaggcaggagaatggtgtgaacccgggaggcagagcttgcagtgagccgtgatcgtgccactgcactccagcctgggcgacagagtgagactccatctcaaaaaaaaaaaaaaaaaagttagataactcatggcacagagatccatagatccaccaggaagaatgaatatgaatagagaaagagctctaaagacatatgacatgaaaaaaagcaagtttcagaatagtacatcttgtattgtcccacttatgtaaaaaagtatgactgtgtctgcatatgtatatgtgtattgtgtgcacatgtatgtgtctctatatatgtatatgtctgtgtctatgtatatatctctatctagatacatttacagtgctgtgaatgtatagaaaagaacctggaaggttacgcatcaatccatgaaccctataaacctctgagaggggaaggcaggagagggctggtgaagggggaccctcagtttgtagtttgcattgtctgaaaattttatagcaaaatatactattaacatttatttttattatttaaaaacttggtttacagaaccacaacaggtcacactggctccctccctcaccttgcttctgtccatctcattccactaatgccactgatttccacttgccttttctctcaagaagggcttctctctttgggagtcctcggacttgtgttctcgaccccatctcagccgcctctgcccactctgtgtctcctgggcccttctctatcagcaagtccacacttctacaccctcagccagcctctccctctctctctcgtcacttcttttttcctttgctacttctacctccagccaccatcttgctttgctctcatgaccaataatattgaaagagaaatgcattcctttgcctatgtctctcataattcataactctatactatctagtttctatctattcctatcacattaaggaaacacttccttggaagtccccctcctggctgccccacccagttgctttctctcaaaactcactctcctagacccccttggaaatatttaccaccactcttttgcttgtttgcagtggcctcccctgcccgcaccttatctccatatccattcttctttgtacggctcaaaggctaccccttccaataaatctagccctttctttctagtaagtccaatgtgtctagcttataaccacctctaaatgtgaatgggttaaatgaaaaaggtcacgttctgttaagaaggcttttgcccatgggtggagacaattgtttgactccaggatgtgtgaattagtgaagggagacactggagggcaatataacagtgaggatacccttaaaggaatctaggggagagataaaaagataattgaggcagagccagtagggagatctgaaaagggtggttaaatttgagggatttttcagaggtagaataaataggacataataatccattggatccagcggggtatgctttgggttatgggagtggggtaggtgagcgagaggaagaagggagaatgagtgacaggcaggcaaatttcattgagctgggaaggcctgtcttccccctgatgagtcccctcttcctccagagctagctgagtgaccactgcctcccactaggccagctctcccaatcccacgctcacagcaccatggatggccgttttcacagttgtcttttacatatgtttaggggctccttgattaatgtctgtctcctactctctcctttaagatccatgaaaggaaggattgtacttatttttgtttttcattatatttccagagcccaactcagtacccagcacatggtagatattccataaatattcatcttaaaaaaaaggaatttagttagttcttagttaaaatgcccttcaccctagaaccacttccctaaacccacttctacttctcaaacactgatgggcccaggaatctaatctcattggcctcattcatagatcagttggtttacgtagctaagcagtatttccaccgggcacggtggctcatgtctgtaatcccagcactttgggaggccgagttgggtggatcacgaggtcaggagatcgataccagcctggccaacacagtgaaaccccatctctactaaaaatacaaaaattagctgggtgtggtggtgcatgtctgtaatctcagctactcaggagactgaggcagaagaatcgcttgaaccaggaagtcagatgttgcagtgagccaagatcgccccaccgcactccagcctggcgacagagcaagactccgtctcaaaaaaaagaaaagaaaaaaaaaaaaaagaagtgttttccatgagctctcatcagtcctgaacccaatgggttctttgcaaatgtttccagtgatgaagagaaagagaagaaaggttctccaagagtgtaaattatccacaagtggatccagcaagactccaacgaagtccacacttggacgactctgctgtcttcgcttctcacaaaatgacaagtcccagttgtatatgcacgtggggtctttggctttaccaaagttggactcacccaagttaagccctcagctgcaggactacgacactgtcaccatcagaggctgccaagtagatgattcaacagggcctagtggcttcagggctaagctctgggacatcggaccttgtctttttggactccacttgttaccagcccagcaatctaggatcaaaagccagtctggcctcctgcttctgggatatggtctctgcaaccggcctctgggtcaagacccagggcttgtgcaaaacttcgattcctccaaaggtctgagatcctgctcagctctcaggagacagaaaaacatggcagctatctcaccagtccccacttctgaaccaccccctcatgagtttgttcaaattcagcttccagctacagcagagctatgagagtttaccatatctctgctctcttttcacccaggaaagaaatggacttatcgcgaataggaaaagcaacacttttaaaattccaaagtccagttgtgttcatattcagtaaccgggagcagtggttcatctagatttttctgttgatatgcacctgatggatattattcccaggtgtgactccaactatctttactgatgtgcacaccctggtgctgatgcacccctcgctgaggtcactttgtgggaaatacaattgacaaggtagggacaagcagccaactaaaagaaaatttgcacaatagacacaacaaacaaagaacaaatgtcctaatattattcagacctcctgcaaattactgaaaaaaggaaaagaaattcaaatgacctatgaaaatgggcaaaggatatggacagaaaattcacagcaaaggaaatataaatggccaataaacatgaaaagatgcgcaacctcactggtaatcagagcaatatgcaatcaccatgccctctggctggatctgccacactttccttctgccccaatcctggacacacagtgtccaccaaaataaaactcggagagggatgaaaaagtgtcagaggatgatgacaagccatactcggtcaagctttgaatccctccgccctggcttttccacgaaaacctctttgcctaccagccttggcacaggtgtgtggattctgcatatatcagctgtcagggcacaacacgcagggaacaaacagaatgtcttggcagcaagtcctactcatcctgaagctactgagagctgggcagacaagaggactgagccaagccctgaggaaggagacccaggagcttgcatggactggaaggaaagggttgctcactcaaggggccacccctctaggcaggcagctggggcatccaaaggacaccaccatctctggacttgtgtgcctctcctggaagatcaaattagataaatcatggaatcagttctatgaatcaacttatagaaaactggaaccgattctacgaagcagaaaagaaaaaggaaggaagggaggaaaggaaggagaaaagggcgggaggaagaggaaggggagggagggagaggggaaagcagagagaaaggcaggaaggtaagcagaaaggagaaaaaagggaccggaagaagaaagacaataatagataatatttattgcatctggcacagttctttgcacatattatctcatttaacctgcagaataatcctttgagagaattattctgcacatgcagaaactgaagttcaagtcactttctcaaggtcatacaatgggtaaggaccatgtcagttcatcacatactgggttttgtgttctcaaccctcaggccacactgaatcactctgacacccagcctctctgcagggctcagacctaggcaccaaaggggctatgaagaaacgagagtcggtttccctgctcatcgatgccttggaagctgcctgggcaggctgggcccaacaggaaggacttggagagctgcagaggctgggatcatgtggcagatttggccccagtggaatggctcagtgagagaagccaggtcatgactcggtgtccaaatatgattctcagtccaggtatgtctcctgcgggtccctgcgggtgcctgcgtgtccttagtaacggcattattattctcctctttctgcatctggtctgattaatctaatttgcacatgtgaatgagaagctgctctgatccatttaatatgttgggaccgcatcccagctcatttgcatggtgggcctggccaacagaggtagctcctgttccctgtcttcctcccctctctcagtcccaccctcccaccaggcaaattcttgctgagcaggcaaacggtgacccatgctgttgcttttaggtcttaaaacccattaggagtatattaacaaacgtgctgagagctcatttgagtaataaaaatcttttttttgtgtgcagctaataaaacagaagaaagaaaagagagaaagagagagttggaggggagaaagaaggaggccatcttcccaccacagttagctaggatgaaatgcgaggatctgtctgcatatttactggaactgggctcctttgcttcagtaatgtgactagtgatgggagaaaaatgtagtggcaatctaaggaatgccttcttttctcgaagcctctgtcatcagggtgcagtccagcaagataggatgggcatctcctctgcccctgaggtgcagaccaaggaccctgttatgattttgaatatttgttgcctttacaattcatgttgaaatttaatccccaatgtggcagtattgagaggtgtggccttcaaaaggcgattaggtcatgaggctctgtcctcatgaatggattaatccattcacggattaatgggctaatgggttaatggattaataggcaagcatgggaaaggaactggtggctttataagaaaattaagagagacctcagctagcacattagaatgctcaggtctcttgctctgtgctggatggtgccctgcatctcctctggactctgcagagtccccaccagcaaaaaagccctcatcagatgtggcccctagtccttggatttctcagcctccataactcagcctccattcctttttaaataaatttcccagtttcaggtactctgttataaacaacagaaaacagactaagatctccagctcacgtacatgcaaaatgaccagtctgtagtaggaccagttgtggctataggcccagaggacagtcaccttgtccaggtgtccttctgtctgcccagcttcgttaactttgctgcttttctcacgcaacgctgctcagactgcagcctgcagatctgtagactcctagcctggcagccctcagatccagttctctgcttctccctgtggcagcctcagctggcacaggtgaaagagcctggtgttgtgtctggtacatggaggaccagctacgtaatcagcatctagtacacaatgaaaaggcagggcccctggttaaaatatgattattaatttcaagaggtcaacagaagagcattaaaccaagctcagggttcttccctgagcagggccctgtatgactgcataggtcagatatctatgaagctggctctggctacctgttagatacttaattatttgtagttgatgtgtggatgcccccagagagttgatcctcaacttaggaagtctaaatatctgggttgcataaacagcccaggctcccggattctgtccttaataaggacattgaagaagaggctttggaaggtcctccccaggtatggccagcctctctgatgcctccttctggtttgagtggccccagatgttccactttcccctaacagcccattaaggccccataagccaagacttatctaagtccttttgtgtgaatccaggagaaaagctgcatagaaatcctcttacagttaatccctttgagaataggggctaaatctacaagactgcaatgccagaggaggaggcaataaaattggagaggacgggcagtgggaagggtcttccctgagatgaacaaagaggcagggctgtggcaggctggacagctttgaaacggatgtctcaaggttgagcttgcatccaggtgtatggtaactagatactttttaaaaatttttttttattttgctatttttttgagatagggtctcattctgtcatccaggctgaagtgcagtagcgagatcatagctcacttactgcagcctttaactcctgggctcaagggatcctcttgcctcagcctcctgagtagttgggaccgcatgcatgcaccacctcacccagctaatttttttttttggtagacagggtctcattatattgcccagtctggtctcaaactcctgggcccaagtgatcctcttgccacagtcattcaaagtgctaggattacagatacataagctgccatgcctaaccagaaactagattcttggccctgggcaaatccttgaacctctctaaggcttttccccagttctttaaaatatgatgaggataactggacatacactccaagatattcatcatagccttgtttatactcaaaaaaaagaagaagaaaaggaaatagcattaatgtccttcaagagagaattttagtaaatgttactatatttgcatagtggaattctgtataactattaaacaacactgaaaagggagatttctttttaaagatgtccagtgaaggtatttacattttttaatctctcttgaaatccactgacaacaagaacaaaaatacagaggagtagaaactgtatctttagggaaacaaggaaatgggtcttgaccacaaaccattaggcatatttgccaaatactgagaaacgtgaatctaaacaagaagtgttgacagtctacacagtaatcctcagaccttcagcgaaattttcttaaaacaaagtatctcagtcctcaaaaggacttcaataaactttttgatgaaagtgacaagatgtgggaatgtggaccagccatgggagtgtcccgcggaaacctcttcagcatttcaagcaggaaggaatgtgaggagactgaaggagagaccatgtgccttttcacccgaatgatggacggccctgtctctgtcctagagaggctgcagagtaaggcagtggacaaatgagacatccatccccaaaccaccacacgcagcagctttggcacagagcaaagagaaatgccggatctggtgagaggacaaatggaccacaaaaccataccggcaatgcagaaccgctcggttcataatcccctttcccaggccccagagttctgcacactattctttggcaaatatttggtccaactcaaaaaaagggagagataattagtagggaactagccagagaagtgtcatagaaattacaaaataaacaaacaaaataagaaaggaagaaatgaataaagtaaaaggctatggaacacatagacctcagagggaattgtcaaaggaagcaagatgaattcagaaaaccactgttgtctaatctcaaagaaattgcagagtttttaaaaaggaattcaaagaaaagtttcaaggacctaaaagaaaaattgtaagataagcgaaaaccatgaaagatgagctgggaaagaaaaagaagtaccacactgaaaacagctaaaacaggaagagaagagagaggaggtagaaggggaggtggaggaggaaagggagtagaaagaggaggaggaaggaggggagaaggagaaaggggaaggaggaagaaggggaggaggaaaaagaggagggagaggaggaggaggaagaggagggagagaaaagaggaggaaaaggagaaggaggaatgaattaaacatatctgaaaactcaactcatgaacttggcaagcaaacttgggaaaattaaataaatacatggaaaagatcaaatatataaacatgattatatggaagatcacagatagggaatattgacaaaagaaattcaacatatccatagagaaaaacatacaaagatataatcgacaaaaacatccctgaaatagtgaaagttgaatttcaagatcaaaagagcacatgaggtctccaaaaattttatatatagcaatcaccttaaagatgtattctggtgaagatactacatttcaagggaaaagaatgaatcatatggacatctaggcagaaacaccaagctaaacaagagagaaataagtctggttggcctccaatcaagccattcgagctccgaggagaactgcagcttaagaggtgtatactcattgaagttgtcatttacatatttagacaacaggtggacattcacgagcatgaattcagggaatacaacacccatgaacctttcttgtaagaagtatctgacagtggactctggcaaatgaagaaatcaatcaaaatacaacacttggaatgtaaaatgtatggcaagaaaattggtggtgagtgttaaatcctattaaatatggaactaagattacacaaccctgaggattgtacagaatggaatataaatgttatagatcttgccaaattaaaaagaatttaaaccaggaaagggagtttatggaaataagaacaaatatacatgcgctaacctcctcctcttcaatgcaggggtggttaataaatgctgcaaaaataataataataaaaaggataataatgactgcaacttcttaacatgctgtttgaacttggtcttagcttcagaggtatatttgaggagctaatgtctaatgatctgaagtttaatgattccttcaacctttgtttttttttccatctgtcgaatttaagtaaaattttgaaaagtaaaaataaaatggtgggtatgtagcaagctcactttgttttcttgaaaaatctgtctttccagcattagcattagtttgttatccctctagatagctagatgtcaagggtgatgccctgaaaaccttaacaatgctctacttctggaatgttgaattgtgagtagtgattataaaatatctcatatttatattcttactgtattgcttgaatgcttaaaatagacatgggtcattttaaaaaattaaatcataattcctgtttacaagctgactaggtggcttctaccaggaggccttgtcttgtgacaatggcagggcctagttctgaagttctgggttcaacactcccccagactattactctcctggtgcctcagtttctcacctgtaaaatgggcacataatagttaataacagctacctctgaggatagttgtggggtatatgcaaaaaaattattatgaggggttggggcgacttaagtgcttaatcaatgttaatattcagggtggccacaaagtctcgttgcatgctaattagaagtgatttgtatgctgcctcctattaaccacataaattttaaattttcccatgttctttggggagccattgctgattgttttcaggcagagttgttgtgaaacaaataattaacaaaaggcctaagcccacacatggggatttagtggccactctgaattgttgtataagcattgccacataaatatactcttgctacatctgttaatggaaaagataaattaaaaaaaaaatttaaagtggtttgcaaacagtatttgtaattaaatggcaatgggtaatgggcccaagttttgtaaaatgagccctggatctgcagtgggccaggagaggaagccgaaagcaggtgcagctgcagggagtggtcaaagtgggtcaggctccctcattggatagcaacctatttgcataaacagtacctctggggctttgccctgaaccagtagagaaggccaggcaaggtctaagcgagctccaagggtactctcctgcctcttcacaccaactccctccttccttctccaactcccattcccctccctccctcccatccatgcccaagtcccaggtacttaggagctggaggagtattatcccaaaagcagtgctgaaatctgtttgaattacatctcctccttccccttgaggtctttacagtggaattggattaatctctgagaacaagtgctcttgtttcttagtggaaaaacagagaagcttttgatttccatgagataagatccctctgtggtaacatagttttgcgcctttctgtcattgctttttacaaggtgactaataaataatccccattacacaagcacagcctgcatccatcatgcccagactgcaggcgctgagggatgatccctaatgggtaataataatagctaccatttattgattggacgctgggtgccaggcaatgggctaagcattcccatgcattatcttcacaggaggatgcagtctctctctggcttcttccttctttgctggcatggattaggttgctctaagcctctctggctgttttgcttcttctcatatccccttggtggggacatgtccagaggccaacaccctggagggactctactgcaccatccaggcaccacaccctgcctcttcctctccttgtcctctgtcattccaatggtctagtctagactggcctttcctcaaacagaagtggtaaaagtcaagtctcagattgagctttagatggaagaagtcttggtccgaggcctttcaggctgatccaagagtggacagctgttgcttttatttgtccagcatttctcttcccattggagaactgccctgcccccatcccatgtggctctgtgcagactctcaatcaaatcacaatgcctacctgccctctagccccaggagaccagccaatatgacaccccatcccttagtccgctgggatttctcttgaggtgtggcacacaacctgagtacagccaaaaacacttcttccatgactttagatctgcagatgtctggggaaatataatctctctctttctctaggatcatgtgaatccaaagctcccagaagccatcttgttgccacataaaagagaaaaaacaggactgagagatgaatgaggtcccagtgacactggatccagctgttcctgaggccacacccgccaccctttggatttccctggaacttaagccaatagattccctttcgtgttaaaatttatttgagtaggccttctctcatacagaaaaatcatggaagtaggctaaagacattctcattggcatctagccagcttgctagagcatttggagccacagctttacctagtaatcaaggtttttttttgtttgtttgtttttgttttttgccagcgccattctttgtacatatactatattttcttgattcaagcacgccatcaataataacatgtgtcgtcaatttaattagggctttttgggaaaaagagagaaagaaaaacacagcataaactgcatttgttgatagtaagatttgttttgatttccaaaaggttaaactattggttagggtgtaggaggggagggagtacatcttgcaattgagaatatatgaaatctccctagggggctttttagaacgagatggcctgaggtagggtccaagtattcctatggcctggtcaaatagcatcttaattccacctaatctattatttccaactctctcctacatgtaggagcttgatgttgttctgagagtgttccccatctggctctggacttgccaatcctcactcgctctccttcttcctcagcaattacctcttctcaatcctttctgggctgggctgagccctgacctgggggtcattcgacaattacccctgaagacaatgggcatggatggctcagcagctgtagaatcccccaccactttccatcagtggctcttcatgctgacatgggaaacccatgaacagagttcccatttaaagaaagtgacctctcaataagaaagctaattagatacgagagagagaaatcttcccagagtaataggaagagctcccaaacccaagcacattcagctagggagaccctctctgccttggccaagaggcagagggagagtgaaagacctacttcctgggcaatgacgggtcatgtgctcatttctggcttaggcattttatgggtgcatctgtgatagtgaaaatacagacagtgcttaggctatgggagaggattaggtggggagagaaaagagaacttttaaatgctcctaatatctcacttgccaggaatcctccacttcccctttgtagaaccaatctgtgatttatttatgattaggtgtaacccatatggctactgcaggctctaccacgcccaggccttgaatgtggtcctgactagggcaaggacatcattagaaggtggagtccaaattagccatgtggccacaggcccaatattatgagtcaagaggagcccatcaagcttgaaccttccttgcactcaccggtttggtatagtgtctatgactgagtttctgcctcagtttccttgactcatgctataggtctcctagcactggaaccttgtcagattctggtcaccaaggtttgggacactgctgagctcaagagtctttcttccatggatggctcctactcctctgatacctcagatttgtattctagcagagcctatgcagcctgcttcccaggtataagcatcaatcatgcacactgttatgatgctatcctctctgccatccagcaatatgctctgtgatgcctgaggtcagaaatgacacaaatagcacatgtgccactattttgctcatccacccccatgcagacatcactaattgatctctgccctcttctcagtgaatctagatgtggtctgaacacatggtttttgtcaaccacaaccaattgactgatattggcaatacaagacaaagtccatttgccctcactaccatatccttctatcagtatatacttggccctcttagaactccagcccatcttggttcatcactcactccatcctgaatcccagccaaatacaaagccaaggtgcctcagtctagagaacctttgagacagtcctcccagacctcatcagggtcccttagtccttaactcagagattaatatcttgcctagaggatggggatgctgtacgttgcacctggagaattctgtgtccccaagaccccacctacacctgcttctattattccaggagcttcaacctagagccgccaatagatcaactgctcctattccaccccatcccaccccagatctcattacctgaccctctcaccaccgttcacctccacactgtttccagaggaacttctctagagtataaataacagataaagataggtgagtagcctgggtttccagagcctcagaaagaaattattctagggcttatcaaacacttcattgttttgcaattgctggttgacaggtttgtctgtcttacttgtgagctcctacaagtcaccaaaagacttggtcctgtttatcttcattttttttccatctaataactagcacaatgcaaggtgggatgaataagcaaatgagccacagttcattcttgggtactaggctcaggaagttcatgctctctgccttctcatcccctataagccaccagccatgtccagtgtggagtcgtaactaccccaaggttccccaggtccaagacagtaaaggcccccaaggagtatgcaagtgctggtgaggaaggtgagtgtcccccagggattccactgccagactctctcaggcatggaaactgtgacacgctcccatctagccataaaaaatgttctctcccggggcagaatgctagctcactgcctctggagattctgcatctagtctggaaagaggcatgccctgtgaatgaccagagcatcctggtgcccacttctggtggaacctaaaaaaggacctttatttaagtcgaagtccagaattgcatccaagatgataagcagaggactggcccgcctcgacctgaagctccctctctgtctccaggactcagacacccctgagcatcacgcctgacctcagcctcatggaagtgacctcagcctcatggaagtgcccactctggggaaagcatacaaggagcacttactcggtcctctgtggatgggaagcaggccagaccctggccatggaacaacaagcttctgagaaacaggagttctgctaagagtcctacagctgttgggatatgggcaatccctcaagattggcctcctctgacccctgttgttgaaccaccttttacccatccaattttaaactaattggtttaaaattgttaatattcagtgttggggagggagtgaagaaatgggtatgcattactgataagaacataaatctccctggaaagcaatttgaagccacataccaaaactctttgaaatggccatgcccttatagatttattctaaggaaataatcagatgcatcccaatgatttatgtataggaatgtttcacgacagcattatctgtcaaaggggaagagtagaaacaatctaaatttaaacacaggggattggctgaataattatagcaatataaatagcataaatatatatatttcgaattttatgcactaatatgcacatatatgcctggaagaataaattacatattaattgtggttatatctagggggtgtgataatagttgattttaattttcttctttgtgctcttgtgaatgtctcccattttcttccatgaacatgtaacacaatctgtaaaagcaagacatgtggtcttgaaaaaagatgagcatatccaaggctggctgtcaaaatgcagtttgagtataaattgtttgactatttgaaaaagcctggagatctcacttaaaccaacaaataattatgctttatggagtgcgcaaaaccaaatcagaattctgaaatttgctgtcaattctctgcactcatctgtcactggctccaactccaagtgggcacaggtgaaaaataaaaccacagacgtgctccatactttacgtttaccacccatctccccacaggttccttcatttcaccttccaaagtaccctgtgaagaaggcagagcaggtgtcaggattcagcctattttaatgcaggaagaaatgaaggtcctgaaaggttaaatgtctcattcatcttgtccccctagtgagcagcatggctgggactttaacatcgggttttccaaccccaaatcccaactcttttagttgtaccatgttgtttcttctcatacaaagtactgtggatgggcagaagcttctgtgagtcaatacaaagaactgctaggtctgagtactaataaaaagatgtaggttaagtcagtagacttgcgcccatctgaaggtggtctctagttttctgcctcagggctctatcatgatgctgttctgttcaacagaactaaggagaacaataggttcacgttcaaaaactctttctcacctaaacacacagatgggcagcttctaataaagttggagctttgtaggaatataagtgaagtcttacgatattcatttattcattaatagctttgtatttatctgtgtggttgcttgtttaacatctcttcccctactaggctgtaagttccatgaggacagggtgtgtgttgttcatgactatattcccagtgcctctcaagtgctttgcatacagtgggtgcaccataactatttgctgaatgaatgaatgaatgttgatttgacatcttcacaacccttctcacctcagcctgttatggaagaaattgaggatattttggtgtgagctccccagctttctttgcctaccccatccactttgcctaccccatccaccctctgacacacacacaacacaacacacaacataccacacaaactcacccatccttaaccacttggagccagctgcagagaataaggggctcttcctccttctcaggaccctttctctctcaggacttagtgatccttttctcttttttccagcaagctccattggtttttaaactcacccttgtctctcctatgagaaaaacaaagccaaacaaacccagaaccccagctggccccacgtctccccttatcattttaatgtcctataagaggtgaccagacacccttctctacttgctcacctccaattcttgcctcagccccctgaattgagggtcgggggtgggggaaggtggaagggccttccacagtgaactctgcatactccagggtagcatctgagagctgaagccaggagacactgtgccgccctgatctttctgggcctttaccctgctgacaccactcctggagcctctgaccccaatatctgctcaatctactcccagctctcctgggacctcagtgatggtccctccatgtaagcctcttcctctgcctgccctgggtctctcccaagactccctcgctaaccactgccctccccactgaaactgcctctccctgagtgatctcacaccctcctggagggttaactagcatatagtagcgcttaactcctaaatccatcaggagtttctttccaaaaactgctgacttcttggacattctgcacattcctttgccttattgcttcctcctacccccactcccccacatttaataaaatattaactcctgctgatttcactcctatgtgactcaaccctagtctctcccctacatcccattcccatggccattatcctagctcacgtctcatcatctcttatctggaccaaggcaatgttttcctaagtgggctcccagcctccagtcttgcatccttgcaatccattctcccttcagcagccagagtgatcttttgaaatgtctaattgtgtcacctccttgcttctaagagcccttcagtggctctccattgtctacaggacaatgttcagatccttaatattcatacaggtctgtctgctgtagagccttccttgccttctgatactattcccagagactgaatcacatgcagctttccaccactctatgtgggccttggcctccagtctttgctcagtctttcctctttctgtctggaatcccttcctctccacttcttcatccttcccttagttcactgaccctcttcctgtaagactcagccacagtggtgccacctccaggaagcagggcctgtaagggagttatcatccacaaccctctaccatactggattataaggataatccatcatctacgagcatttaaaatgtgccacatagtttacctgcattctcctgttatgtccttttaacagtaactctgtaaggtaagttctattgttagtctcattttataaacatggaagctgaggcttagagaggttcagtgactggcccgaggtcacaaagggtgtaaccaatggagctggacccgaatccaggttgatcgtcagcagggcctgccacactgactctcttgattttttttttcttttttttctttttttttgtgacggagtctcgctctgtaacccaggttggagtgcagtggcacgatctcggctcactgcaagctccgcctcccaggttcacgccattctcctgcctcagcctcctgagtagctgggactacaggcgcctgccaccacgctaggctaattttttgtatttttagtagagacgaggtttcaccgtgttagcctcggtgaaggatggtctcgatctcctgacctcgtgatctgcccgcctcggcctcccagagtgctgggattagaggcatgagccaccgcgcctggccagtgatttgtttttgagcttccttctgccttgggaaggcctagccaccttcttttcatcctttaggtctttacttcctctaggaggccttccctaacccattcaccttaagtctggcttggatgcccttccatttcactcccatggtcccgtgtcaaccccttcacagccttggtcactgtgttttgactactggtctagccccaagctgggctgggggctccaggaggtctcagggagaggctgcctgtgctcatgagtgaatccccactgcctggcactgtgctagtaattcctgatcagattactacatgcttcccttctttttcccaccagaggctgagccccagtctaataactctttctaataacttctacatataaaggtgggttggggtggactgctatcaaaactgacaaaagtccggaaatcagtttggtaaactggcaaaggagtcccatttccatttgctctgaggtgaggtaaacgttgcagtgtttccatcaagatgggaaacagaaacgaagagaggctatgagcacgtgcctaagagagtccattctttccccaccctagttcccggggcctctccaccagttttgtttatagctcatgtccaatagtgagtgaaaagcctataagtgtattcttttttttaatttttaatttttgttgagtacataggtgtatatattcatggggtacatgagatgttttgatacaggcatgcaatgggtgataatcacatcatgaagaatggggtatccatcccctcaggcatgtatcctttgtgttacaaacaatccaattatactgtttcagttattttaaagcataaattaaatgattattgactatagttaccctgttggggtatcaaatagtaggtcttattcatgataatgattttttcaacccattaatcatcctcccctcctccctccccactcacaacccttcccagcctctggtaacccataagcacgttctgagtgacgagatgagttaaatgaaaaggagtaatttggacatcaaggcacctgagtgatagaaccaggtctgctactgacagtgagactataaacatcgctttgagtggctagaagccgtttcctcatctgaaaaactgggaatttgggctgaatggttcacagttttcttccagttttaagtctatcaggaactgtcttgtggccccacagcctctccgattccaccatctatgcctctctccccacccatccccacgagccacccaggactccttgctcctccagcagatcaggcccacctcagagccttgcccttgctcttcccgctgccgggacactcttctcccaggcttcagtccttcacctctttcacctcttcacacaaataccaccttctcaaggtcttcccaaactgcccatctaaaatggtcatccctccaccccagatccgtcttatcctcctctgtttcttaatttgctttgcacatcaacatgtacatactacacaattttctcttttaacttgtctattttttttttcttttttgagagtcttgctttgtcacccaggctggagtacaatggcgtgatcttggctcgctgcgacctctgcctcccaggttcaagtgattctcctgcctcaacctcctgagtagctgtgactacaggcatgcaccaccacgcccggctaatgtttgtaattttattaaagacaggatttcatcatgtagcttgtctattatctgctccatatactagaatgtaagctccataaggacagagaatttttatctgttttattcactgctctgagcctagaatttcaaattatgcctggcacacagtagtaagtacacaataaatatatgttgaatgaataaaagattatccttcaaacacacacagtcacataaacaaagccagtgaaatataaccaagtcccatacagcttccttcaacatagctgccagggcctgggcacaaaggggatacatttgcctctccaggcttgtctgcattttgttttcctggggttcccatctgcaatgggccagcaaagcttcctttttgtgaaccaacgattagcctttaggaagaagcccaacactaagcccaagccacagattgattaattgttctctaggtgtgaacgctagcaagctggctgagcgttatggccatcgacaaaggcactgagatgggagctgagggcagttcagccttccggggagggctgctttgaaagcagacgttgcagtttcctttcaagtattatcagtcatcatcgtgccattatggagttttcaatccatcgttccctgggcaataggtgcctgccaggcagagatgagcttctgtgctctgtgccatgggcgagcctttgtctgcgctgccatctgctccctggcacccatgcacacacacgacctgcctctctccctcagaggggcatcctcttgacaacacagtccttcttgcttctctcaggaccgcggggtagaacccaccagctctcctgagaccccaaatccctccactcagccaacatgtgctgagctcctgctgggagctgggcacctgcttcagggagataagtagggagctgggaagcccttcggggcaggggctaggtctcctttgccaggggcggtactgttcttggttcccagctctctacagcctgatctgccccttcttagacctctggaaggagctgacactacaactgctgcaagaaccagaaacagacataactgttttccaggtccacacctggggaaaaaaaggggcaaagggcactctctgaataccacaggcaaaggcagccttggggagtaaagagaatccctcttttctgtctctgctcccttgcgaggtcatctcatctgacctcatggctttcaatacaatctacacgctaaggatgctccaacttacatgggcagataggttctctccatccagctgcctacccaccagttcctcccatattcctggcaggcttctcacacctaacagtctgaactgagctcctgatctccgcaccccaaacctgctcttcctatgggctttgccacctcagttaagggcagctccatactgcccgttgatccccccaaaccctgggagctaaccttggctcctctccagcacccacttctaatctgccagccagttctattagctccaccttcaaactgtctggaagatgcccacttctctccgccttcaccgttgcggctctcacccagagcgccccctggcttctcacctgcattgctgcattagactccgggccagtctccctgttcccactctgcactccttcagcatattctcagcacagcagctggttaaagctaggtcagaccaggtcagcttctgctcagaacctgcccatgggtcctgataaactcagtagaagccaagttcttcccataatgtaaaggctgtgtgtgacctggtcccttgtctccaactttatctcttcctaccactcgtctccctcactctgctccaggagcactggttgcatctctgttctccagatatgccaggggaactctcaccttgagaggtcagaagtgctgctggctcagagcctgggaattccccagtaggccatggtgtggaatccacagtcgctctagtgtgatcttttcctggagcctaggcaagcgaccactgtgccctaagcgctcagctctccagcagttgtcacagttgtctgattttttatctgtctcctccactagaccatgattgcccaagggcaagggctggtgctacccatgtgggtttttccaggccttgttcagaagaggtattcaaggcatatgaatggatggatgggtagatgaacaacagcaacaacaaaacacctaggtttgcataacctttatagtgtttgaggacatttcctcctgtttgttcttggttggacaatgagaaacaaagatactctctgtaccaagaagcctcagccagaagccaaccagtccatgtgtgcctctaagcagggtctgtgcttttccccaagacagctgggtgtgcagcacaggaaagaaaatatgtattctccctggcttatgaagggtggagctgctaaaactacagtcttccaggcatatttctcaagaaaagaaggaagtcctcctgtatcttacccctcatttgagacggacacagaagctttaggagaagtgtcccatgaccatactagctggagcccccagaacccaggtgcatgtacccacattcttttcctgctgaaaattcttttccttcccagggcaaaatgggatcttggaggggaagcacactcgacctcactgggcatggctgtatgtgagctctgctgttatctcattatgctcatacccctattttacagttgagaaaactgagcctcagagatattacagagcattccacagtgagtggtagattaacccaagaactctatgattccaaagtgtaggcttatcctattgtcccagcagtgtcctttctcttccctgcctccagaagtgggtgggagactagctaggtgagaggcatgaggagccaccatggcactgggtctaggcttacttgggcctggggaaagctaatgcctgggtaaagcacccatcccttcccaggcactctgcagattcctggatcacaaagggctgtaggggttccagagatgctggagctctggtacaacaggagggccacaggcctggatccctgcagtcttattgttcatggcatctgagaggcagggcctagaccaatactagggattagaaagcactttggaatcaaagtcaatggaatgagtggataaggagttgctgatttaaagtattatagatccattggattagcgactcctagatttgtcatggattttagaaagcatctagagcaagcccctatgcagttcagccaagcttctcacacgaataaatcttcagcaggaaaagaatgtgggtgcatgcacctgggacatggggctcaagaaagtatggccagccaccagaaggatatctctgaaatctcctcctctatcttttgaaagatgcccatttacactggactccttgctctgtgtgtgtgtgtgtgtgtgtgtgtgtgtgtatgtgtgtatttagtttatgtgcatgaatattttatttatatacatatatttagttaagatttatagtttatcattttatttatagagaaacatatacgtttttaaattttactttaagttctgggatacatgttctgaatgtgcaggtttgttacacaggtatacatgtgccatggtggtttgctgcacctatcaacccgtcatctaggttttaagcccctcatgcattaggtatttgtcctaatgctctcccttccctttccccccacccccaataggccctagagtgtgatgtttgcctccctgtgtccatgtattgtcactgttcaactcccacttatgagtgagaacatgcggtgttggttttctgttcctctgttagtttgctgaggatgatggattccagcttcatccatgtccctgctaaggacatgaactcattctttttcacggctgcatagtattccatggtgtatatgtggaagacagtgtggcgattcctcaaggatctagaaccagaaacaccatttgacccagcaatcccattactgagtatatacccaaaggattataaatcattctgctataaagatacatggacatgtatgtttattgcagcactatttacaatagcaaagacttggaaccaacccaaatgcccatcagtgatagactgcataaagaaacatatttttaaaatatatatttggttgaaatatatgtatttagtttactatttgatatagatagatagatagacagatagaatgattgtatgtatatttgctttacgataagattagaaaacgtgccacatttagcttgtaggctttggtgctcccatcatgcaaccctcagggctatattgtatttcacagttttttttcacatataaacaattcagaaattagaatgagtattacaaccaagggtacgtgatcgtttaactggcactgttttctttcttagtggtgcataaaataatggtacatcttacagtcaatagaatgtcaactttgataaaatccagtatatatgccagtttggaaagtatgttaacagaatccttggcagagcttgatcaatcaaagccttgcttgatcacctccagaaatgaggaactcattacatcacaaggcagcctactccaatttagggtaattaaagctatataaaacaacttcttgattcttggctgaaattcacctacttttaacatctttccattggacattgttctactccctgcagcaatgcagaacgaatccttatttgtcttctgtgagagaaactctcttgtcacttccagatcttctccttaactattctttgtttcatagttacttgtctcattaatttctcccaaatacctacttagttttgggtcttgtgctagagatacaatccatgaccctcaaaaacatcttgtggccaggcacagtggctcatgcctgtaatcccagcattttgggaggctgagatggaaggatcatttgagcccaggtgtttgagaccagcctgagcaacatagcaagataccatctctacagaaatttagccgagtatagtggtgcacacctgtagttccagctactcagtagtctgaggcaggaggattacttaaacccaggaggtcaaggctacagtgagccatgatcacactatagcactccagcctgggtgacagagtaaggccttatctccgtaaaacaaaacaaaacaccttgctactgatcaatgctttattacatgaatttccttcttctgaatgcatccaccctccaagatccagagtctatatttccattaatagagccatgtgacatttgattcatgttatgttcatagccaactgacacctccacatagctttcacacaagccaggacttcactgatgttggtttgagtgttagtttactctgattttggtttttctcccatttgctatttatcacacaaacaacacttgagtagccataaagaggaacttaaaaaaaaattcacccacatctcactgcctgcccacgtcaactgtttctttttttatttccatccagtccctgttcatataagacctactttacatgtttgtaataaatatgaagaatccattttgcattctggttttttcacagaaaataatatcataaacatctttctgtattgccaaataatgctattatacttttaaatgactgcataaatctattaggtagatctaccataatttgcctggccatgcccctactgttggacatttttacagtttccaatttttcatcattataaataatgctgaaatcaacactttcatgcatataactttcttcttctgttgaattatttccttaggatatattcccaggaggggaattactgggtcaaatgacatgagcattttatgactcttgatacatactgtcaagctggatttccaaaggactaatttacatcagcaccagccatgtgcgagtgtgtctgtgtctttgccaccactccagcactgcatcatacccaccgaagttcttcagcctaatttaatagggataaagtgccatttcattgtcttaattgacattacactgataactatcaggaccaggtagtgctgctatgtatttatttgctgactctatttcctctggtgtgaactccttgatacctttcttaccactttgtatgggttcattatacaatgcagaggttaaccctttgttgccacatttggtagaatattattcaagtcagttgtttctcttcccattttacatgatttttattgtgcagaacttttacatttgaatatagtctgatcactaatcttttccttttgttagattttttaaagtacaaagcttgacactgctccctattatagtggaatatttaatttggatccaatagtcgcaactatgtgaaattattttattcctttttgtagactgaagtcaaactgtctggattcaaacccacactttacctcttactagctgtgtgacctcaagcaagttacttaactttcagtgcctcatctgtaaaatggagataataatagggcctacctcaaaggactgcttgagaattaaatgttaaaatgtaaggcacttagaagagtgcctggcacctggtaagagccccagcaatgctagctttcattatcatcctgacgatcatcatcacccaatgcatttgctatgtctccctgccctgactcctctgcataatttcccagtatgatctctagggctccacccacatcactcacaactggagaccccagcacttgaacattcatctattcagcaagactcttcaggtgagcttgttcaatcagttacagtcacatctgaatgtcagcagaacagacagaaatatcacaaacaactgtgtaagcaattgtgaaggctaagctgctccacgtagagggcattccttctattccagcagtgtaaatgtccatccataaaggcaatgtagggagtgagccctgggcttggtctccccttgtcctggcaccatcctcagtgctggtgaaggttcagaaacattctatgctcgacagtggtccctgctttgcctcctgtgactggtttccttccccgcagtctgcccctgctctccccaatgtctctaaagcataaatctcacggagccacttccctgcctaagacccttcagcgatggtccccttcttgtgagtaaggcccgaactccttcctgtggcctcctaggtcctacatgagctattccctgtccctcaagccagttcagctccggccacacccctgccctcatactccacaactgcccttcttgcagttgctcaaatgcctttgctctttcttctggtctttgattccattcattcaccaaatatttactgagtacctaacatgtgacaggacctgtcctaggagctgaggaatcagcacagaacaatagtaatgcaaaacaacacaaagctcctgaccccaggaagctcacattcttgcagagaaggacaataagcaaataaataaacagtcatagcatatgtcaggaggtgctagggagtgatgggtaacaggtgctgtgttatatacagtgtggtcagaaaaggcttctcaataagaagacacatgagcacagagctgaatggaaccagggagagggctttggggccactgggtacaggcaaggggaacagaatgtatggaggccctgaggctcaaatgtgtttcacctgccctgtcccctccacttcccaagattagctcctggtcaagtaattcattaccaagcccagtctgtttactctgcaaatatagctggataaaggtcttgagggataacaggaagcggagagctggaaggaaggatgacagagctgggaagcaaagccactgtccatgagacgggtctcaggcagcaacaacgccctgagcaaggccagggctggggaccacaggctcaaggagatgccccagcgtcatgctgctggcccacccgactctcccaggcctctcctgctgtggggtaggggtaggcgagtggggcaggcctggagaactgtgcagggcttattttcagcaggaacacggtggagagtgtgggctttggaaccagactgatttttaaattgtgcatgacctttaggtcctggttcacctcaggcaaggtaactcacctctctaggcctcaacttccttatctgtaaaatggggatcctaaggccttgctcacgaggtggttatgtgtcggttgttgtctataaagcccccacccctgcattgctgagcatgtcgaaggtgctcgacaagtgccagttcctttgttgtcttcatctcagaggccctgggctatggaccctgcagcttgtatgaggataaaggactgtgaaacaactcctatcatgtaacggcatccacaggggaaggacagggatgccatctgtccaccgccaaatctccaaatcagaatctcctacctaatgcggtaagtgcttttctctcctgctgttaaaatgaaatatcagtgggttcaactctcagttattcacattaatgaaggaaaaggtagaaagaataatccaaaacagtggttaatcactcctgagttattcattaatggcaagaggtgggactgaaatattcaatttgacacttctgtttggaagtgttctctccccactgatgctgggctcatgggttgggaaataagtcaccccaaggaagaggtggcagaaaggcatgcatcccctaaacctctagggctggggtcagtggaggaagctccaacagggtcacctgacccaagggcacaggaaggagacagatatgcatgtccagctacggtccctaccagagcagcagttgaaggacaaccctctccccttctatccacacgggagaaatcacatccaggtccccacccagtggttcttcggtaccaagggatccatcctgggaggggctgggagtgggctggcagtggtcctgagctagccatgtttgggggtctctgggcccccctgccttgagcacggttatgggaggcagggtcaagcctggggcaccctgctgcttcccgtgaaaagggtgtttatcagctaaagacctgtgctaataagtgttaaatagagttcaatgcagaaaattgagaagtaatgagacttggagccaagagaataaattaacaggtgatcacatggtaaagagtccccacctgaatgctgaaaaggaggaatcctgaccatcagagagctctgggtcagagaacaggttggaatgataagtacacctcaactgaggctaaggggtggttaggagcaattaagcagttaccatatttcatcggttctagggtgcaagcttttccatattttaatatctctgaaattaggatgtgtcttatagtcaatggcatgtcacactttaattggcagcatttttttctttcttaatggtacatcaactaaagctggatcttacgactgggggcatcttagagtcaaagaaatatggtatcaggtaccttgagcctaaatctcttttcttgcctgggcctttcacatggggcaagacgatcatttatccattcacttgtttaatcggtatttattgagcacctactatgtgtctgaccctgggctaggcacaactgtgaagagtgatcctaatagcttacacatccacttagtgagtgtttattctatgccaggcattattaggagcacttgatgtgttaccccatttcttccctacaacaatcccatggagtagggtttattattcttattgtcctcctatgataaggggtcagaggaggttaagtgacttgctcaaagtcacatgctggctactatctggacgagttgggagtcaagtcttcctttagaccctgagctctgacttcagtgctctattgagcgttcttcctgtccagaagcacacacaagagtagagaaggtaaacaaggaacagaaaatacacgagtgatgcacatgatagaaggagaagtgcagggagccaagaggtaatagaatagggctgttgtacacaggggcagcctcttggatttagtttaggcagagaacagaagagaagagttgggtggtagtggtgaggtggttcaggagaggggactcagtgtgtttgaaagacaagtgggaagacagagtatggtgcatctgagaactggaaggggatggaggtagggctcatgccggaggttttgatggccaggtaaggagtctggactccatcctggaagcaattaaatggttggggatttccattgttgttgttggtttggtttgtttgtttgagacagaatcttgttctgttgcccaggctggagtgcagtggcgcaatcacagctcactccagcctcaaccccctgggctctagtgatcctcctgcctgagcctcctgaacaggtagggctacgggtacataccaccatgcctagctaattttctttttaatattttgtagagatggagttttgctatgttacccaggctggtctcaaactcctgtcctcaaatgatcctctggccttggcctcccaaagtactaggattacaggtgtaagccaccacactcgaaggatttaaagggctaaaccctttaacccaattaaagggtttcaagtgaaagctctctgagatctttgctcccaagcatccaatgaatctctgaatcttttgttggatagtgaatgaccacagactcccaagaggacggttctgaagtaaagctccaaaaccttcaagttgttcaagttgagtactgcgaaagtatgcccaggcagaggggtgataaggattagaacccagcctatacgctatccactgagccatatgctcacaggacagggtcttctcagagtagccacttttgtgttgtacaaaagccttatatagactagtagggatccaggtcaggagatgcaagcaatagctaccattgcaggactcctactgtgtggcaggccctagactaaggtatcatggtggcagagaaaacaaaaaagtaagtgatagttcttgccctcggagagccacaagatttgaccaaaggttttgtcaggggaaagaattgggtttttttcactcccataaaacccaccatgccttgttatattagcttccttttactgagtgcctactatgtgccaaatgtcaccctagattctttctagaccttgtcattcatgctcacagtcctcttgaaatggagagaaaattaccccatttttcataggaggagtctgagaggtgtagttccttatctaagggcatacactggggatatggcagagctcaaacttgatctccagaaacctaaccgggcatgagagcaattttctccacgtggtagacgaattggttgtttttgaatagcatctctgtgccaggcacttgtcacgcactgactctttaatcctcattacaacctattaaagtgggcattatagtttctgttttgcaaaaaaatcatttcagggaggttgggagacttgcccaaggtctcacagccagcctgagggaaagctagggtttggatccacatctcctgtctcctgggcttatgcccttacttctctcccaacatttttaggtttcagagctccttgaatgtaggggccacttcttattctttcttgtatcctcaaagcctactttgggactgatatatagcaggtgttcagtaaatatttgttgaatgaatgaagaatgaatgaatggggacagagaagtgaagcagaggtacactgtatctgcaagcaggcagctgcgtgagaatgctccttcctcctcatcactgtttctcctgacaccctgacaggaagacggtcatggcactagagtttggcataatatcatcttaaagctatgttaatactcttccccaaaggggtaaaatattactatgcatgatgaactatttgtgggattattgaggacgtgatatgaaaatcatcctgattctccacttattgagaagtgctgcccaatttgtctcaaatgtcacgtctctatgtattaatttgctactccacagtactgattaaaatgaatgttctccaactcccaaggcagagccatcggaaatggaacaggttcactcaggaagcacacaccatccctcctgagcggaggaaatggacatctatcacctccctccctggaggagggcattggcctgctgttctgctgttctggcctggagtggcttaaatgctgcaaattgcatattcagtgtatgtctatctatatatatgtgatcaaatggcttccattagcccaattttgagatgtctgcatcatgtcccagaattggggaactcttttggaatgaggaaattgtctgagaggctgaggccgagagagagaatcagcaggtctaattacaggaaaaaacaaaaccaggaaaggcccatttctcccatgtacttgcttccaattccatctctggaccccaatttatctgcgtgcacagtggcatgatcacctccaaccctactcccacctccaaacatcacagaagcacactgtgttctgaggcttgctcctaacctgcgtctcctggaacagcaaaacgggcagctctggctccatctgtccatccctcacagatgagtctgtctaccctgttgcaacacgctgtggtccttatacagagatgatattaccgatcttccattggtagcaaaagcataccagggttttgtctttttttttccagaagtgacactaagtggagcatgtcttctttctccctgctcccctttgggaggggagatagactagggagagagcacaaatcgtgacaatgaaaatgaagcttggatgaaagtcaaggactgcacacaatatgtgcccagtaaatattagctcaatgaacgaagaaatctctaccatcaacttaatgtgtgaggtcaacctctctgggctgtttttttaggtgaactaggggatcggggtggccacagggcatctgtaaactccctgtgaatcttatggaagagttgtatttgtgtgagtacgtgtacatgcatgtatgtgtgtgtgtcacagttttcaaatccatgacctcaaaagcctagggcctatttgacttcttactaggacccttagctctaaagccaacatctctgatacaaagagaagaggccatgaacagactaagttcctggtttggcctcattagctcccatccaccaagtgacaaaacctgagacttcatccctatccaatggacacaggctcaagcagtgccagaggctcatgaatatgaagaacactctgcttcttccctccaaaagccaccgtctggctgtaaagctagacacaccacgaacagctggattaaggattttatgcaaactctggagccagggtactggggtggggctgggattgtgaactatgaagttgacatattccttccatcccctgaaataatcccagtcaagtaaggttaggatgagagtgacttaattaattagctgacatttatcaagcgctgacaatttgccaggtcccatactgagcacatcttgtgacttgtgcattctcttccttaatcctcacaacagctctaagaagtattattcttatcctgattttataggcacagaggctggagctcaatgaaatgacataacttgtccaaggtcaaccagcaagtgagtggcaagataggatttgattccaggtgtctgaattcagaacctgagatcttaattcttgtactatgccacctttccccttatggttaccaaggagtccacaaaaaataagggaaaataagggtacctcatccttctaagattcttcatagagatcattagtggaatagaacaggtctgatttttaaggaagcctatagtttgatagtgagatgtccagatcacagttagacttagctaaacaaagaaatacctgttttgagagctagagtattaagtagatctaacagactgagacccgacactcagagatgggctctccttcacaaaagtgtcagagtgcacgagatccatgctgctaaaatgcagaggtgcaaccaggattaagcactaaaaacctgcagagactcttccctcattggcatttctgatctgcccatcacgctcgcttacctggcgatcagtctggaataatcggaaacaatctcatgcaacagttgggagttgtgtgtggggaaggtgggaagtctggggctagggtgagaaaaaaatgaccaaatggcaggaagactggaaacatcagatagagacacactgggggtagagtggggaagatgcaggcttccatgaactcggagtgacacatggcaagcatcagagagccaaagacagaaagggagacacagaaaccaagatcaacacatctgggttccaggaggatttaaaaataaacagtaaaataaaactaaaagaataaggtgagcctttaaatgaacatttatctaatcttcacacagaagaagcctctccaagcatggcaccaaaaatagatagcataaaggaaaaattaaaaaattaaaatgtaaaatgagtggcataaaaatgaaaactgctgtacctctaaaggaaacccattacattaatatccttaatatgcaaaaagcacttacaaagaagataagaaaaattctaacacccccatggaagagtaggcagagaccaagagagaggatttatacaattatcagtacatggccagtaagtgatgacaggtgcttcaccttacctacaatcaaagagatgccaattatcgcaacaaatgggatgtcattttccacccattttaatccatgaaactgacttgtaacactggcaaggtgggaggaatgggctcaggcctgcttgtgtactgttggtagaagtgtgcgttcgtataacctttctgaagacacgatggaattatgtataaaatggaaaatctacatactctttgacccagcaattgcacttccaagaatttattctaagaagataattagatgagggcttaaattgtatgtacaaggatgttcttcacctaaatgtccacagaagatgactggttagataactatggtatatgcaaaccacaatggcttcctcagtgatgttcattagaaagacaaatcagggctacttttattaacacagaaaaacgttggcttcattaaccagattacagaattgcacagatagcataatcccaagtgcacacggatccacacctgtgtgcatatgtgtgtgagcagatagatgtctaaatgtatattcattggaatggcagaactgaggctagacctgggcagacagccctacatgggcagacagccctacatgggcagagcaggacatgggcagacatgggagtcaggaggaggaggaggaggtaagtggggcgagggctcctggggcctattttcagactctttgctgaaaatgggattgtcagttctagcaactgaaaatgcaggatgctcagttatatttaaatttcaggcccagtgtggtggctcatgcttgtaatcctagcactttgggaggtcgaggcaggcagatcgctccagctctggaattcgagaccagcctgggaaacatggtgaaaccctatctttaccaaaaatacaaagaaattagccggctgtggtggcgcgtgtctgcggtcccagctacttcaggggctgaggcaggaggctgaacccaggaggtcgaggctgcagtgagctgagatcgtgccactggactgaagcctggaggaaaaagtgaggccctatctcaaaaaactaaataaataaaataaaataagtatatttggggtatacttacactaaacattattcccacttcaaaaatttgaataatttaaaattcagattaactgagtgccctgtattttatctggtgaccctagctgagaagctcaggaacacatctcttgttgcctccatggatgacccacaccagcctggaagttcccacatcctcccctgcctctggcttatctccagtttacctgcctgtgaaatggagtcactagcctctgccttactcaaagagttttgcagaaaagccacgttaaaattcctggccatcaggccctaagctgcacacaaaacttccctgaggctcagcatgtacttctgtaagatggatagcaatgtctgtccacagggttgtggtgggggattaaatgagataatgtatgtaaagtgcctggcatacagtcggtgcttaatacaggttgatccccttccctcccgtccagctgctgcggcccacgctcttgcccccggggattacaaaccaagcaccttctgtcatctcagggtttgactaccggcctttttgatcttttccttgcggcggcagcagccgtgggctgacactcatcacctgacttcacctttctccaaaatccctagcagcagttcagttccttatctatacttttcacattctggatgagggtggaggaggatcaaactcgctttgatagcagacatttggggatgtcagccaagaggagctaccaagagcagggccctgatgccattttgaaacggacacaacaacatcatgaatagcgaatataaggaaaccatcctgactgggggcagcctaggctggaagtgggggcctcttctttgaagcctgtctgtcattctccctgcttgccacccagcacaaatgtccaaggggactctgcaatggaggaagggggctgagctccttccctgagagccaaatcttcataaattccttttgactagtgaatctcccctcctccaccccacaatgaggctcagagagcttaaaaatctgcccaaggtcacccagtgagtcaggtacaggttcaacccgattcagttgcctgttgaataagctcaacgatagacatcccagggcatatatcaggtaggtatgctcacagctgtggctgaccctactcatgcctcccaccttccatccttgtccatccactgtgggtgttccaaaagtaagtgcaactcacatttgtccagatgcatgaattgccacatagcccagtcccaaatcaaattaatgagcttcagtgatagccacagccttggcttatgggtgtctgactcctttgttagcacagacacctgtgacccactttaccatgcagtacaaaacagccagccacacatcctgcgtagtttgcagaaaccctgcaacaggtgactgcatagagactcgctcggctacagcaatctgttagcattggtctagcctttgcaggggccttgcctacaaggctttatttccttagtgccaatgacttagacacctgacatcattatgtggctgaggtgaaataggctgttccttctgccctgtgagtcttgctgtggaatgttgagcattctcatgcctggactgcctcacctgtgccaggcaggtgggaggagggatccactggcctctaatttatccctaatgttttgcaatctcttttgaatcaccggcctctttgtgaatccgatgaaagctccagctcagctctgtccagtaaaattttctgcaatgatggaaatattctgtatctgggctgttctacatggcagacaagccacatgtggttgctgaacatttgacacaaggctagtgtgactaagaaactgaattttaaattctattcaattttagttaatttaaatgtaaatagccatatgtggctgatggctactgtattggacaatacagctgcagaccaggggtaagtaaattttttctgtaaagggtcaaaaagtaagtatctcattggctttgcatagggtctctgtcacaatagctcaactctgcagttgtagtgcatgaagacagccaccaaacacatgtcaacgaatgggcatggctgtgttccaataaaactttatttacaaaaacaaccttctggctagatttggccagggggatctgagttctctaatgcctgctgtatattctccctagaaaaagatatacccaccctcagaatttttgtctctaatgtcatggagtttacagacctcctgttgcccaactacagaccctgctcatgatttccaggtgacagtgtctgttttcacgggactctgaatgtgccctcagatctgctctgcttaatgagaagtgcttgtgcccctaacagggcagtgtgggcagggacacctttttcctcaagcctcagggaagccagggcctcaaagatcgaccaggactgagaaatgagggcaccatgagagcctagggcccggccagttcccccatgtgtcagtcactcccagcatctttgctggcacctcttctagtgtccctgacccagtctcccttttcctggccccgggtcccaagtgcagtcaatgtccccaaggccaacctattgtggaaggagctaatggccagacagactttaggaagcttctgaagaggcttctcctagtgaggagcttgttgctcaaacttggagagaattactttggattcagggccaggttgaaggaataaataggatgacaaaaatcacaggcttgatattggtaggaacttttttttttttttttgagacagagtctcattctgtcacccaggctggagtgcagtgccatctcccaggttcaagcagtttttgtgcctcagcctcccaagtagctgggattacaggtgtgtaacaccatgcccggctaatttttgtattttcagtagagacgggattttgtcctgttgcccaggatggtctcaaactcctggcctcaagtgattcactcgcctcgtcctcccaaagtgctgggattacaagtgttagccaccacacccggctgagatctgatcattttttaaaaagaaattaggctatttcaggaatcctcactttaaggacaggtcagtctttgtcaggagccctcagttaaggtaaaatagagttatgtcagaagccctcagcaaaagacaggtggaactttctcaggagccttctcagcaacctttagttaaaaataactgaagccttcccaggagcccccagttgctcaggttaaagcatcaaaccatctcccctataccccctgccaccaggggtggttttttgctaaggaggcagaacttgtcctctttatgcattacacccctggccaagacagggagtgtctgtttctgtattgctatagcttcttcattgaagaaagcatcgcttactctttaagttcttaaacaaaggcaaaggcaaaaaaaaaaaaaaaaaaaaaaagcttttggatatctggcgtgctttactagggtattatgtcattactgttattaattatcattaacagtcttaaaatatgcctattaatgatcttaacacaaaataacagtgcaggtcttagccaagagtggcataattacctattaatgagatgtaaatttcccagggaaatgacagagatctagaagtaccaccttctgaacataataaagttaataataataatagtgtataatctgaagatattagtgttaatttgaattctaacaccatatttaaacagactgagagaagtacaaattatttgcatagcacaaaccaaaagcccctaatccatgctattaaggaaaaatcgattgttcttctctgaatgatataaaactgactcttggcagtcattgtatggtgttttcagttgcttattttatttcttttacttagggtttatatgtcttttattttcaaaaacaacctgaggtaccttatacaatgaagcccaatataaaacagaattaaaaaaataaaaacacaacaaaacccagttaaaggggacagagaagtagatgttaccaggccctcaggataaactactgcacatgagctttgatttcaattctcagtttcctgggaaccaagagggacaatttaagtaactgagttactggttagtaaccagccttgtcaggacaggcgcaagctctgggtctgaagaacacttccctgcatctgtgagcaatgcagtcctgcttgtggctattaggacatcacatctccggctcctgtggccgatgagggaggcacttaccttcataggtggcgtggaagccttgggcactgactgcatagtcgctgatgaggcgcagagagagggtggtggctgcactaacaatggtggctggcagctgaaagcctgtgagcctgaaagacaaagaattggattagggagaatgacccccttgggaaactacacatccacgaagcatttattgagtgcctgctggatacacagtgctgatctaggcacacagagggtgttcaaagacaaagtgattctcagcagaggtgatgaaaaccagcaggcttctgccccagaaacatgaggaagtgactccgccaaagccatggtctaatccccaacctggaggcttgcctgcttcctttgtgtttcctcttttctccttttctgatttcttttcctgtctcctctctttctggctgaggtcctgtgaggctctgggtataattccccatgagtttacaactaacaattgccagtagacaatatttattcacatagtaagggaaatagagccaactctaagtagaagaatgagcatgcttcttatcatagactttattctttcaaaggaatgtctactgcttttatagaaataagtgcctattagtttttaaagaaagcaaaaaataaaaaaccaacacaatctagaaataattattcctgacagttgacatacaaagagatggtgggatcaatagatggaatcatattcaatgaaataatttcatacaaatgggatcaaactgtgcgtgctattaaaattaaaatgtttaaattttctttctggaatttaactgaataaaaggaaacaggtgtgaagctaaaggaattgttgaacctgaaataatatgcttttagcacaagataatcatttttaaagattcctctaagggaaaaagataccactgaacacttgggaatacatttaggaaagaccttgtccactgctgggcatccatgcctggtgaccctcacagggacctgattgtgcacacaggtcatagtgaggtggccagtctcctacacacctttgtccttaaccccctctaagcctcagcctgccttaccacacccaggtaggaatctaggaggaatttcaaggtttaactttgtccccatttttaggtaatttgaaatatccgtggttctcctgggtgccgctgtatacctcccactgctatacaatatcttgatgcccaggatatccactgaagggcatgagtatcgggctcagatgagttaaaccagatatttgttaacagacactgtgaaaacccttatgctagatgaagcccttgcccttcccaccatcctaaccttgtgggattcatgttaactcagaatagactcaagaaaaagcaaagaaaaaattatcaaattatgcagcaggcaaccaaataagtttcaagggcatcttctcttcaaatataaacacatccagcaaaagatccctacctcaccccatattcatatactctctctcatcaaaaatgtatacataaaataatgaaatcatacatattataaggaaacaaactttgtttaatcatcttatgctggggaaaggcctcctaagcaagacacgcagaggactctctttgcacctatttgccctgtcagtcttccatgggagctgtccatggcatggagttctgatggtactccacctacccactagccacagagctaggtaaatgatcaatcgcgacatactagccctcatttttatggacggattcagggtatggggaagagggaagagaccataccacccaagcagagtcattccgagtccttctatgggatataatatacagactctgaaagccttttatttttggaccttaaactactacaatataagcttgagactcccagcagcctttttatcatcacacagagactatctgctttagagaaaatgatatcgccagatagatataaataaaagctgagcagtggcaagagaagagaaacagaaccctgatgatgtatttttcagatccttaatccatgcagcgagatttatctcttcaatgcccagttacataagctaacattctttctttactttctttttttcttaaactagcttgacttggttttctatctcttgaaattgagtgctaatggatacaacataaaaccccagaggccttaaaggaaaatattgattaataactacatgaaaattaaaagcatgtatgtgtgacaaaaaactgtaaaagataatgagaaaagtgcaacctgaaaggttacgaatatgtgacaggaggaggattcgtatttataacctagaaaaagttcttacaaatcagtaagaaaacggtaaacaggaggaaaagagcaaaagatacaatacaaattaatgatccacctaattaatataaaaatgtgaaaactgaaaccccaagactcatttttcacctatctagagttggcaagggctaaggaaaacagatcctgcacttaacaacatgataataaggaaatactacaaattacacacatgcatttcacacattaaatgaaatgggcacaaacttgaaaagcacaaactaccgtaagtttcccaatatgaaacagatcacttgaatagccctataactattaaggagattgaattagtaattttaaaactcccaaaaaagaaatatctaggcctagatgatttcactagagaattctaccaaacatataaagaagaattaacaccaattctactctaatctcttccagaaaagaagaacaaacatttccaaactcatattatgaggccagtattactctggtaccaagccaaagacaatacaaataaagaaaaatgaagatcaatatttcacatgcatacaaacacaaaaaccttaacaaaatattggcaaggagaattcagcaatatataaaaatatttttacaccataaccaagtggggttgtgtctaaagatgcaaggctggttcaacatttgaaaaatcaatcagtgtaatctaccatattaacaggttaaaggtagaaaaatcacatgaccacatcaactaatgcagaaaaagtatttgacacatttcaacacccgtttgtagttaaacgaaaaaaaaaaattcagaaacctacaaatagagggtaagtttctgaagttgataaagaacatctacaaaaaaaaaaaaacagtagctgacatcacacttcatggtgaaagactgaatgcttttcccttaagattgagaaaaaggcaaggattcaacaactcagttagaaaatccgcaaaagacatgcaagagacatttcaccaaataagacatatgcatggcaaataagcacatgaaaagatgtttaacatcactagcctttaaggaaatacaaattaagaacatgaagaaatattactacatacccattggaacagctaaaataaaacactatagtcacgatacccaatgctggtgatgatacaggaaaactggattcctcatacaatgctggtagaaatgcaaaaacatgcagccactctggtaaatagtttggcagtttctttaagaaaaaaaaaaccacataactatacaactcagcaatttactccagagaagtggaaacttatatccattaggcccaaaaacctatgcataattgttcatagcagctttattcctaatagcccaaactggaaacaaccaaaatgtcctacaataataggtgaatgactaaacaaactggagtacatccataccacagaatactactcagcaataaaaaggaatggactatgaatacatgtagcaatttgggtggacctcaaggtcattaagccaagtagggaaaaaaagctaatctcaaaagatcacatgccatgtgattcaatttatataacattctagagatgataaaattaaagagatggaaaacagattagtgcttgctagagattaggaatcgtaagaggaagggaaatggatatgaccacaaagaggtagtatgaggagatctttgggtgatggaatcattctgtgtcttgattgcagtgatggttatgggaatctgcatgtgataaaatgacacagaagtatacacacacattgcaccagtggcagtgtgctggttttgagagtgtgctatagttacataagatgtaactattggaggaaactgggagaagggtacatggaacctctcctgtgaatctattattatttcaaaataaaaagtttcatgaatacaaatctaccatattgacttctgattagctccagtcttgagaatgcctcctgattcctattttatttactgttcctagcataagaatatgtcaatcttgatgtttatcatacaagttacaggctatgacacatacagtacccttgcctgttctagaggctgcttttcattgtctggctggacacatacaccctttccctatggtacatatgccctgggtctggggagtaacattgcagagatctacctgccttgtggctacccaagaccatgcttctgtctgtgaatttccccagtaaaacaccctctaccaataaaaaattaaatttaataagttttaaaaaattatatctatggctcatattatattgctattggacagtacgccagtcctccattagatcagacttacactcagtctccctggattgggctttgagctttgtcttttccaggcccctcactccagccgcctcctatccactccagcctgtattgcaccctccccgcccccaccggcggcactgactgcagccttgctgactaccagtaccagaactcaggccacagggcccccgttagcctattccttggcttcctgttgacttgcccatgcaccagttgccctttccctcccccgaaatattcgtatcttcagtgacagactgacatcatcccattgtaccctatggattaaaatagtaaattgtccccagcaaggccagacctatatctggttccccagaccccatcctagcaagcgctggttgtctccatctccaggtgggcccaattcacagcagctgcaacttgtctctcacccatgtctaccagaattatgcccttgggtgcccttcccagacactcagcctagggaccatcctttccttcaactacatagagcctcatggaggaagctcaaacctcaccaggccttctcctatgaagtcctctctgagaatggcattcctctcactaagcagaaattgttgattttattccccaacttagttccagtatatttttgcactgccattaaagattcctagaccctagtttctcggtactatattgatgcgagctgtgaatagctaatgtacactgtcaacaaacaattacagttttatcacttacaatatatggaattgcagcttgctaggcattttctctaatcagatatttaccactgctctgctctttcccagggttggtagataaattccagcagggaggattcctcaaaggcgctagctaaggctgggggaggggatgggaaattgaatctccccagctggatacctgaatcatcgctcccccacccacttatctttgagatcgattttagacacgctgaagaccccgcagttaggaggagctatggtgttgcatgacagaatgagcaaataaaactttcagactttcccatcttttatctgacaagattaaataccatattgaaaggagtgaggtatccttcaatagtgaaatccagacttagcagagaaatgcagtaaaatgatggcaaggcaggtgagagtcccctgttgctatgagttatcctccttgcagactctaaaatgcacagagaacagcattttgcaaacaggtggcatagccaaacgtgtaaaacaatactcatcttctgctttacatcagccttattgtcttctcattttctccactgtcttttctttgtttttgccttcctgccaaaagtaacccagagtcttgaaaatgggacggccaggacaccatatactcctcatttctcagctcagaatctacccacagcctcccactgttcttaggattaaagccagaatccctaacgaggttcacaaatcctgcatggcttggccctgacagattctctgctctgtctcctgcctggctccagccccccagtcttctttggtcaaggccatcccaagggcaaaggaagtggtcagcccaaagtgcaggcaataagggcattaatttcctgtagggaatttgaaatcaataataaaatggactttaaaagttcacttcttatcaccatgcatccatgttctaaataatgtcagtgattaaatactcttcccccgcttttctcccactcccttccttcgtacacctgtggtttcagttccttcaatttgccatgccccatcttcagggtctttgcacgcactgtctcccatttagaacactttctaacccttgggatttgtctaattaactctttctcatcattcaaatcttatcacgagtgtctcaacgttacttctagaaaggtgcattcctgacatcccagaccagcctattctgcatgctcagaggtcccagtgaagtcactggtatggttcaccttgcatttccagctttccttctagacacagagtggaacagcacctcccacccctgtggaggtcaggcctggccatgacaccagcttggccagggagatttgggtagcagtgaaggtcactgttgccaggagggaggcttgaacagcctgtgtaccttttgctgaattcccttccccttatccaaggtcagtgatccttggcctccgcagccacggtctctgagcaactcccctaagcaaagagcccctgcaaacctcttttgaatctgcagcatgagcaagaaataaacttttggtgagttaagccatttcaatttgagggttgtttgctaccaccatgttttcacttgtaggttttgttactaccattcaggtatggtgaggccaacagatcagaagacactgccgctgaaaagataacacagtttcctagaggaaggggcatactatgccatgcagggccacaagcatgtcagaagctccagcgtcagtgacaaggcagaaggagcctgggtaaatgtgggcaagagcctttattgtggttttcccaagaaggaatgggcaagatcaggtaagcagctgagcaggtttaggattgcctagtttgaataatttcagagggcaccagggtatgtggaccacccttagctgtctgatgtatggccctgggtaattagggcagggggatagtagataaacaatgagatctcaataaaagaggtagaggccaggcatagtggctcacacctgtaatcccagcactttgggaggccaaggtgggaggatcacttgagctcaggagttcaagaccagcctgagcaacatggtgaaatcccatctctataaaaatgttttcaaaaatttgtctgagtgtggtggttactcagctaaacttgtggtcccagctactcagggggcttaagtggtcccagctattcaggaggctgaagtgggaggatcacttgagcctaggagttcgaagctgcagtgacccacgatcgtaccactgtgctccagcctgggcaaaaaagtgagatcctgactcaaaaaaaaaattaaattaaaaaaaaaataataaaagacttagttgtgctctacccaattgggatcatcagtttgcatatgaaaggcatacttccgggagagctctttgctattttaggtcaacaaagtcccaagatgtcaaagtatcagaaaatacagacaattaaaaaaccatgattagtacacagagtataacctgacctatcctgactgacatcccttttcttttcttttctttactagcactaaccataattcctaattagatgtttattggggtgagtagttttcattaaggtctccctgactagatgaaagcaccccaagagccatggctgagtttgtgttgctcaccttgcatgtgtatttctaaatgaatggataaatgaatgaatggccaactatttggtgtttcgaggagcagccacacagagtcttaggtgactctgatgctggcagtatagacaacaggagggagagacatccagacttgggctaagtaacacttagtgacatggcaaatccccttcacacccatgaaatgaggcgagatataaggaaaaagcagactgcttcgaacacctccacttcttcctaatcattccaggaaaaataaaagggtgggagcttttattttaaagagggtattattaggctgtgtgcagtagcttgtgcctgtaatcccaacattttgagaggccgaggcaggagtatcgcttgaggccaggagttcgagatcaccctggtcaatatagtgagatcctgtttttccaaaaactttcaagaatagttgtgcatggtggtgcatgcctgtagtcccagctactcaggagtctgaggcagaaggattgcttgagcccaggagtttgaggctgcagtgagctatgatcatgtcactgcattccagcctgggtgacagaatgagaccctgtctcaaaaataaataaatgggccatttatttatttatttaaataaggaagaggggacagaagtgctggactgtacacaaaaggactcccattctaagcagaaggacttgaactcccccaccagaatttggctcggatacaactgagcttcctgccttcaggtgtcactgaggccttgagcacatcaacaatgcccagtgtggactgagacctgagggtcttcctggaatgccaggtctatgtaagaccttgcttgggagaatcccaacagtggctgaagtgaaattcttcccctttatgcatgggactcaaagtcaaattgtttttaatgcaggaatatgacatttcttccacccaagtgaagtgtctgcaaattcctacccatggaaatgaaagctcattttcttactccaggagtttgtgcccatgtttgagaacttcaaggctctcaagctgaccaactactcacttcctcaggctggggtctcttggctttgacgtgccaggcttgcagcaaggagaccctaaaagacccctcaccctgtggggtgaggaacagttgaagacagtaggcacgtatagtctggggtccaacagagttggcaaggcaaaggataagaactgtctccacatccctagggccatgcttgacacaccaatgtcctcatgaaatgcttggcaaagaaaaaggaccacaggacagaggctccagagagacacacttgggctccacgcagagaagaacactggcattcacatctgccaaaggtatgagcgtgccacctctcaagttcaatccaattttaatccctcaaatatttactgagtggcaacaggtctcagatgctgatcctcagagaggaggaggaacatacctggttgaatcttgggccaagctcagagacatggctttgcttttgccagtcagagaaccagtgagaaaggccataatgaaactctgatctcaacaaactccaacctggaattatggagtctattagtacattgggttgaccccattactggagtaaatgtaagtcttgattcctgcttgatagaaaaacatagaagacagggaaagacggaagaattaggctttgtccaaatgtcttccaggcacatggaactttctgaaactgtctggagtagggcggctggcaaatcaaaacactatctgccaagactgtcagtgtgacaagtgttgcttacacttactcttttattcccaaggtcaaattggcatgtcatttttcatatcactgtttgatgtgctaacagccttaaatgagaaccattcaataaaagcccaatttgctatattaccatttattcctggataattctatattagttgggctctttaagattgtctctgtgctgccccaaaatctggagaaccatgtgataaacccccacttttcataactttctgaggatggaggcagagccctgagtcgtccctgagtgagtgttgctgggactggttccctaggcctcaagtgaaataagagatctggatcagctagaaggacataatgatcaggaatgacagagatggatggctctctgggtgacgtggcccgaggctttgccttgcaagacctggcctgcctttctttctacctcagctcatggctctctcccctttggtctttccccctctacccacactggcttctattttttgagaaggagtctcgctctgtggcccaggctggagtgcagtggcgtgatctcggctctctccaagctctgcctccggggtttcacaccattctccttcctcagcctcccgagtagctaggattacaggccaccaccatgcctggctaattttttttttgtattttcagtagagatggagtttgaccatgttagtcaggatggtctcgatcttctgaactcgtgatctgcccgccttggcctcccaaagtgctgggattacaggtgcccgccaccacgcccagctaatttttttgtatttttagtagagacagggtttcacagtattagccaggatggtctcaatctcctgacctcgtgatccacctgccccagcctccctaagtgctgggattacaggcataagctggcttcttatactgtccttgaaggtgccacatctcttcccatctcagggcctttgcagatgctgtccctaggactctgtgcccagatgtatccctttgccacccaggcggcctccaccttaccttccccccaaccctgcattagcttttcagggctcactttcagcatcagttcctctgggaaagagtttagggatccttgataaatgtcctcagagaatagagtacttctactttgtaacattcatcccaatgatcatgaatcgattttcttactgaattgttatatatctgtctttccttcttgatggtaagtctcttggaggcaaagactatctataaccttttcactatatcactagtgcacagtacatattagatgcaatatagagtcaataaatgacggtttcactatgagaaagcagacagaaaaggcctgactgctatcctttgaaaggccagcttacaagtataatccctgtctggcatctgggaaccgggatttcaggagggttccctccatttccagtactttcaagagaggtctaaacaatttgtacaaacattatggtttatgctgaacacctgctttccacctgggagcctagaattttggtatgtgacaggaagaggggtctaggtaatcatctctgtgggaaaaccctgggcaatgagtctctgctgagctttcctggttggcaatatttcatatgtgttgtcacaattagttgccaggggtttgaagcacgacctgtgtgactttgccagaagaaaactcttggaagcttgtgcctggcttctcccagccatcgccccaggatgcaccttttccccttgctgactttgctctgtatcctttcactataataaatcatagccatgggtacaaatttatactgaatcctatgagtcctaataaatcatgcgggtggtgatgcagaccccccaacacagagactgacaaattaatacaaccagatttttctggaaagtaccaaaactaggttatttttcaaagcatgtttctagaatgttcaccggttaaacagaattgggaaatgctgggttaaataaagcagggatttttcagaaaacaattaaaaaataaaatgcgtaggaggacttttaacaagctaagtcaatgtaaaccttcaaggctggaatagattatgtaacagatcccaaacccattatattatagccccttttattcctaaagcatcctgtgggctggggttctgtggaaccctctctgggaaacaataggcccagagaatgcaggttattatgaagctgaggctgttgctacaacaatcatgaggctgttgctatgtcagccatgaggctgctgacactccctatcttgaaagttctgaaacccagagtgaccaaaggtctgagatgtggttctgtgctgccccgagatctggagaaccatgtgataagcctccacttccgagggtgatctatgcatgtctcttctttgcaatcttaaagagccaaactaatatagaattacctaggaataaatagtaatatagcaaattgggcctttattgaatggttctcatttaaggctgttagcacatcaaacagtgatatgaaaaaagacataccaattgaccttgggaataaaagagtaaatgtaagcaacgtttgtcacactgacaggcttggcaaatagtgttttgatttgccagcagccctactccagacagcagccactagttagatacataaaccattaagctaaaaacagaactatcattacaggcatcatctagtaatttgcaggtaattgatggacattagtcataatcacacaccatacacacacacacacacacacacacacacacacacacacacccctacaaacacaggttttcactggtaattcccctttgcatttcatcaagagcttctaaaactgggaaatgtggaaaatctaggctttttgtgcctttctatatatacatcatagactcctttattcttaaagcatcttgtgggctggggttctgtggaaatctctctgggaaaggatatgcccagagaaggtagatcatggagctgaggctgtagctacattagctatgagaccactgacactctcagtcttcaacaccctgaaacccagaatgagaggaagtctaaagagattattcttgtgctgtctcaagatctggagatccttgtaataaactcccatttaagagggcaatcttgcattagctagatatctgctgaaaaaacccaacttatgtccaaaggatcttgtctagaatgtccctgcctctccagaaaacatctactggctctgcaaacctctgctttcagctgcacatgtgcatttatttttggaggctgggatacctgtcttaagtatgactggatgggagcaaagctagacctccaaatccccatatacagtacactttctaggatgtggactctctttagaagcaagatctggagtcacagcagacccacctgctgaggtctaaaaataggggagaagcactacgttcagaatgcaaatcctctaagcacactcgctccatcaaaactcaggggtgtttcccattggactgcagcgtctccttctgcagcagggagccctcttgatgtgctctaccccaacggttcccaaatcatgttgcacagaatactatccaatatgatgttagtaggtttgcctgaaaaaaataagtaattttgggaaatgcaccatggttcccaaacggtgcaccaaggtgccccagggcattgcagtgagtttacaagggtaaccaaggactatttttaactttcaaaggaaatagtggcacttaatatctgctggacacacaaactattagctcaaggtggttcacaatttcagtgtaaagctaccttccgttagatgacatcatatctttgcaaagctttggtagttggtgtgatgggaattagggaccatgtgtgaatcagtgtggaacaggatatgcaggtggtagtgtccaatctgagtccaaggtttgagaatctttgcaatgaccaacaaggaaacacataccattagcaatcaattgttatttaacaattatttaaggatgaaacaaaaatgtttttctttcaatttatattatcttcaaacagatacagagttgttggggtataaatacttattcagttatttggacctaactacttaataagtggagctaataggtatttcttttacccatggagcaccgtggaaacattactgagacactaatggcacctaagaaactttgggaacctttgcattactgtatgaaaagctttggaaagtcctgaataatagacaaatacagttggatccagcgtaccccacacttcttggttcagtacatgcatgaatagctttatttacgacatcagttgagaaactaaatagatgttacccatgatttgtctctatgatctgataggttcacaaaagagattaaggctggcttattcccaccggtaacaattacaaatttttctcatcaatcattcattcaacaaatattaattgtatgccctattaaacgctatgtactatgcttggttctcaggataaaaatgcctaagacgtggactcactctcgagggatttaccctcaaacggaggcatttacattaatttatctagaaatccagccagttctcatcaccttcattactaccatcctggaacaggacacctccatctcttgcctcaattactgcagtaacctcctaaccagtcttcctactttcctcctagtccacctacagatcctctttaacacagcagcttctgtgatcatcttaagtcagatcatgtcacttctctgcttgaaacccttccaaaagcatcccactcgatttgggataaaagccaaagtcttcataatggtctaaaggccctagggaatcctctgctgccactacccgctcccactccatcaccaccctccttatcaccaactacctccccctgctcactcactctaaccataacggccgcttgctgttcctaaaacacacctggcaagttctgcctcagggcctttgcacctgctcttctctcagtttcctccagctacctcatctcttcccccagatgtgtatggcttgttccttcatcttctgcaggtctttgttcacataccctttacaccgaggctttgataactattctacttaaaattgcaaccctcctcccctcctgtcccatttcctgattccccttgtcctgcattttctcctaacacttatcataatctgacttcctatatatttgatcactccttatttattacgtctaccttttcccaccagtgtgtgaattccacgagggcagggatttctatccacttagttcacttatctaaccccagtattgagaacagcaccagatacaccataggaggtaattactgaagacacaattataatgcaatatagtaagtgcagtgataaggatgcatccagggaacttgatgcaccagcctgagctgatctaaaaagataaattgttagccaatcatccaaagggcatggcgggctgtggtaggatacggaggtcatctcaaagaggatggcacaagcagaggaaagacaaaacccactttacgtgtaatttataaaattgttccccaactaatgacaggagaacaaatggatacaaccagatgttcctcctccacttgtttgccatgactgcttaattaccagtctccccaagagaggggatttttctggaggctgctcagccttctagcagatgcagacttcatttacttccacagaagcctgaaaacccctgagccaacttggtcttccatgacagagactgaagtatccagcaccacgtgtcaggaggttggcaaggatggaaatggggaaggaagctttgaggaagagaggtcgtcatgttccagaagcctgcctcccacttcgtggccaatgccttctggcagtggctatgcagcagctgataataatgatgatgtttgttattaacccgtgcacaggtgctgccttccatatctacctcccctaaatcaggcttagtgacatcacccatttaggaatggaaactgctctctgtcaaggcagcccttaaagtttggaccaccccaggaggtttgatggaacagctgagatttacccaggccctcagatggtgccaggctaggatttgttccttgtgtgccagagagacacaaacaacaattataaaaatatcagtgaatggtcagcagattctgcatcctgagggctttgtgcccacctaccccctcggacagctgctcaggccaacctggggaaggagcaggtggagcctctgagaattctaagaaggcaaaagatgctgaacatgcctgcaagaggatggagaagatggacagaaagaatgggggtcttctccttacctgctctgtaccacaatgcccttcctgttggccgccagagctggttttgagcaccgcacctggtttgaaagattaggtctccatttaaagacagcgctttgcagtgtgctacaggcagcacctgtgcacaggttaatactaaacatattattatcagctgctgcatagccaccaccagaaggtgttggccatgaagtgggagaatatcaggccctgtctttgtgaactggacagaaatgcttgttggcccacttggaagggagggtcaggcaccaggacactatgcccactgtttcccatactccagggaactaggagaaacaggagcttccagaaccatggtctccagaaccatggttccttctccagaaggaaatgtggagagacccttctcagtaagaggggctccagggtttttgctcaggctgggactgcagggtaggctgagcccacagctgtgaagtgtgaaacgtgattacccaagcccaagtcacacgttgtgaacagtggagggtcaacctgaattacatccaaaccatcgatatttgcagttaatagcaaagaggctttacctgtgggcctcatctgtagacaagagagggaggagccacagaggcagtaagagagtttggtcactggagagtttttgcaggtggttcagggactttctcaggccttacttcccagtgtctgttgtgaacctctaactctgctgcagcttctaggatttttcagggccactatgttgcacatctttcaggagcaccattcatattacggtagatgaccctggattctgaactgctgccttatccctgaattctgcttttctgcctggacccttaggataactgtcagctggaatttggaactgggttttgccccccaaccccagatgccatcttttgaatcacttttagtgacatactgtaaaacagggacttgctcacccctaagatccaatccaagtgtatagagtgaggtgccacagaagaaaacatgaaaccctgaagacagtggcaagctttaagggactgacatgtgaaaacaagtgaggtatcacttcccaaaaaggttccattgattgcgccttgtcatactctgccagttgctctgctttatttttctcataacaattaccactacctggatggcttaggtaatggactgagtgtgaactcccaaagtttatatgttgaattggtatttggaggtgggatcttcgggaggtagttaggattagatgaggtcataaggatgggacttccaacatgagattagtgcccttataagaaaagacccctttctctgcctctcttgccgaccctgtctgcaatgtgaagatgcagtgagaatgcagctatctgcaagccaggatgaaacctctcaccagaatcaggccattctggcaccctgatcttgcattttagccttcaggacagttagaaaataaatttctactgtttaagccacccagtctacgagtattttctgatggcagcccaaagagaccaaaacagattttggtaccagaagtggggttcccaaaatggtacccttccctggcatgataagccaactaccctggtggcagttagataacactggactgcttccattgtagaaggagaagtgttttgttcttactgaaacagacacttattttggatatggatttgctttccctgtatgcagtgcttctgccaaaactaccatccttggacttacatagtgcctaatccactgtcatggtattccacaatgtgctgcttctgaccaataaactcactttatagccaaagaagtgtggcagtgggctcatgctcatgggattcactggtcctaccatgtgaaccctccaatctgaagcagctggctaggtagaacaatgaaatggccttttcaagactcaattacaatgccagctaggtggcaataccttgcagcgctgggacaaggttctccagaaggctgtatatgctctgaatcagcatgcatatatagtgttctttctcccatagccaggattcacaagtctagaaatcaagggatggaaataggagtagctccacttactattacctctagtgaccaactgacaaagtgtttccttcctgttctatgaccttatgctatgctagcccagaggtcttagttccaaagggaggaatgctcccaccaggtgtcacaacaatgatcctactgagctgaaaattaatgctatgctagcccagaggctagcatatgctatgcaagtccagaggctagcatatgctatgctagcccagaggtcttagttccaggtgtcacaacaatgatcctactgtgctgaaagttaagactgctacccgggcactttgcactcctcatacctctgaatcaacaggcaaagaaaagagtaactatgctagccagggtgattgattctcactaccaaacagaaatgggactgctactacacaatggaggtaaggaagattatgtctggaataaagaagatcccttaggttatctcttagtattatcatggcctatgattaagatcaatgaaaaaccagaacaactcaatccaggcaggactattaatggctcaggcactttaagtttaggtcaccccacgtggtaaagaaccatgatcagctgtgatgcttgctgaagacaaagggaatacagaatgggtagtgaaagagttagttataaataccagctgtgaccacatagccagttacagaaataaagactgtcattgttatgagtatccctctttattttgttatgagtgtttgcatgtgtatataaggatatatctattcatgtgtgtatataaatatacgtaaatataaatatataaatatacacacatacatatatattaagtaatatgtatttgttttctttttcctttttcatatagcataagatataataactttatgttatggtatttaagtattgttacttttacaccatagtatttaagttgcaggatatcaggaagagtaaacaccattccaagattttgtctcctcctctggtgaggggttaatgcaggatagtcatgtcatattaggcaaaattgtaagtttgttattgtctttatttggcagttaagtgtgttttaagatgtatatagtgcagagttgacaaggggtggatttgtgatggttaatatcaggtgccaactttacagggcacaggatgcccagatatttggttaaacattattctgggtgtgtctgtgagggaggttctgggtgagattaacatttgaatcagtagactgccctcactaatgggggtgggggttatccaatccattaagggcctaaatagaacaaaaatctgagtaagggagaaggtactctctctgactgtcttcaaccgggggtattggtcttctctcgtcttctgatgggaactcagactgaaacttacattatcagctttcctgggtctccagcttgccaactgcagatctcagtcttcacaaccatgtgagccaattccttataataaagcatatgtatacacacacacacacacacacacacacatcacacatacacacagtagcgttccccatctgcagagtcaaccaaccatgcattgaaaatattaaataataaataatattaataaaaataataaaaattttaaaacaacgcagtacaattactacatagtgtttgcactgtgttaggtattgtcagtaatctagagatgatttaagggatatgggaggatatgggaggttatatgcaattactacaccattttaaataagggacttaagcatctgcagatttttatatccatggggggggggtcgagaaatcaatcccctatgggacaactgtgtgtgtgtgtgtgtgtgtgtgtgtgtgtgtgtaagaaagagaaagaggagagagagtatcctataggatctattgagtatcctataggttctatttctctggagaacccagactaacacagctcatttatatgtgtgtacttgttaattgcctatcttcctctatctgaatgcaaactccatttagaacaagaaggactgtgtccatcatgcttactctagtatgctcagtccctggctcagtgcctggtacacagtggatgctcagtaaatatacacgagattgaatgaatgaatgaggaattggtggtataagtgtttcgagaagaattaggtcattggcagcaagcgcttttgaggggcttggtaagagacgactaagagggtccgtggatttggcaatgaggacagtggtggtgacctgctcgagagcagtgtcagtggcaaggctgaaactgggggacaaagagcaagctggtgatgggaaggaagcatgtgagacaaggagtttggacagctctctcaataagtggctttggaaggaagagggtcaatggcgaactacttttaaacaaaagcctcttttaacccctaatcagaacatgctcatttctacctctctctactgtccatcccttcccacgccttctcttggggcacacaccatcaatcatctctcattactttattttttaatagaataagcaagttcatgggcatttgtttcagtctcatattcattctcttgataggataataattgataccgtaagtgacctcattaatcagcagggacaattagaatgatgtaagtggaggacagtttgccgtgtagcctgtctgggaaagactgaaaggtcaccagatctcgaagtcagaatgggatgcttccatgggtgactggctcttctttagtccaccttcttgggtccctcctagcaaagtggacacaagaaagctccaaggaaggttaatatgtaatggtgtgtgtagtttcaatacaggtccattatgattgcggtgctctactaccctagaatccctctttctccctttgtttcctcaggaaaacaagtccgcattgcttcagagtctgaaaaggcatatgaacatgcaactttagtagatgaatttcttaaaatgtagtaagaaacatgctatttccaggcatcctccggcaaatcttttgatcaagttgagtttctctgcaaagtgcactattatcatctttatttccttttgaaaagagttactgggtgggaaagcaggaaaatacaacagatatggaatgcactagcttcaacaaggcacttataaatgcacaagaaagggaaagatgagctagactttatcacaataagacccattgattactggctcaacaactgtacacagttgtcaactgggaatagggctctagcagcctgcggcagagctaaatccttagccctgcccagcccacctgaatttgtaaatagactcccaattttgaaataatttcagatttatataaaagctgcaaaaatggcacagaaagttcctatatactctttatccaactattcctaaatgtcaacagcttacataaccatggcgcatttgtcaagactaagagataacataggtattttactattaactaagctgtagactttatctggattttgcctgtttttccacaaatgtccttcttctcttccgagatccaatccaggatactacattgcatttgccctgtaatttttaatatcttctctgggaacagagatggcatactgatcaatttatgactagtacgaagccagcaggaatgtcctagataataattaagaccagaatccaaaaagtttcttcaggcttaatctagagaacttgcactaaagacaggcatgagtgaacttttgtccttgggtctgagatccaaactataaaagtggtttctggccaggtgcggtggctcatgcctgtaatccctgaactttgggaggccgaggtgggcagatcacgaggtcaggagatcgagaccatcctggctaacacggtgaaatcctgtctctactaaaataccaaaaaataaaaaataataataataattagccgggcgtggtggcaggtgcctatagtcccagctactcgggaggctgaggaaggagaatggcgtgaacccgggaggcggagcttgcagtgagccgagatcgcgccactgcactctaggctgggcgacagagcgagactctgtctctttaaaaaaaagtggtttccaaccaggccactgtcaaacattattggagctggtgattgtctcttatcgtgtgagctggtgtgaaaaaagcttgagactttagggcaccttcccagaactacgtctctgtaaggagaggtgatgattccagtctattctttgggtttgtttacctcctaaatgcttttattttttctaagtcattttcaaaaataagaatcttttagagacacaaggatgaagaataatataataagcacctgtatatacaacacccacacaggaaataaaacactgtaaacatagttggagcccctgggtagctctgcctccccctggcatggtgacaagaccctttgtaatctggcctctgctgcttctcccagcagtcatccactctctccccaaacaacaataacaataaacaagcaaatagccagtctactcccaacttttcagctgtagaaaaacaaactgtttttcctctgctctcactctacgacaatcaacacagaatacttctgtaaccaaatggaggtgggatggggttccccacaaaccaaacaagcaatcatttctgcagtggatgcaggctggatgtcctccagtgcaattcaactctgattatctacctgaagttagcatcaggtcccgtaggttgagggctcagtctcacaagactgcctcccaccgcagatgccaatcacaagaccctggttgttttacctttacttctgaccaactggctgtaaagcaagattcccaggaccccctcccccagatttgattaatttgctaatgtggctcataggactcagggaaatacttacatttactggtttattataaagaatattacaaaggataccaatgaacaccagatgaagagatggagaggccaaggtatggaggaagaggcatggagtttccacatcctctttgagcatatcagtctccaggaacctccatgtgttctgctatctggaagctccttgagcccagtctttctgagtttttatagaatcttcattacataggcatgattaattaaatcataggccagtggtgatcaactcaaccttcagcccctctctcctccagagtttgcgggttgacactgaaaatcccaactctttaatcatggcttggtcttcccagtaaccaaccccggtcttgaagatatttagggatggcaagccaacagtcaacccattagcattcataagatgtgtatcactttggagattccaaggatttcagcagccgtatgtcaggacaagagacaaagaccaaatgtatatttcacaataccacaccagccatatagaatggcatgcaattccctgaatatcaccgtggtacactcgcttcagctcctttacaccactgttcccctgcctggactattcttcctactccatttatcccctgctatctcccaactcccatttcttctttaagacttgtgttcaagtgatatctcctcaggaacaccttccctgattcctggtgctctgcctctaatctctcccagctctggacacatccctctatgctgcactggcttgtctatttccttcatgtttctgcctcaagactgagttctccaaggtcagggcctatgtctgcttcatctctggatcccaatgctaagcataaggcctggaatgaagaggtctttggggaatatctgaaaggcctgcaatttagtataataattaggaaaatagtctctaaagctagtagtgctttgttttgcatcctggctcagctgtgtgaccttgggtaagttctttaacatgtctgtgctccattttccccttcatcaaatgtacggttaacaatggtatctaccttacagagtgttgagaggtttcaataacttaatacaggcaaaatgttttgaatggtacttagcacagaataagtgctcatagctattacaattatttctatcaaaatgttcagcacctgtttagctatatcacctgggttggatttccactaaaacaagacctgtgttaaggatttggctacaagtgagcttatttgggagttgaccctaagagcacagtgaggggaggggatatgaaacagaaaagagaaggcagctgagaaaggggacctggtcatataaggtgccactgggagtcaattgagctaaatcccattggggaacactgggagtgagcatagaatacgcaactcagagtcatcctattacaggaagaagaggctggggtatcaatacactaactccctccttttgggttgctggttgctcctggggtcattagctccaaccaatgaactatggatgtggcatctactggatctgctgcgtctcccctccactcccagtgacacctgagcagagagtgggagcgaaagcctagcagcactgctgactgtgccctgtggctgcttggagtcttgatctcctcaagtcccttgagcaccacagcctctgccctggtctctctgcttgattccatcctgaccacaaccttccaagggctggaatcacagatatgcaacagcgctgaaaactaattcaggtgcccacccaggatgccacgccaacctcagcataggctgatggctggcaggaagcttcccttttcccttctcctagacccctaagccctgagcctctcgctgtttctatgctgtttcctgcagctttagagtgggaggctcctggtggaggcgatgccctggcaaactgtcaggacccctcccctcctagcaacactacagcaccttacactgattggtgtctcagtccccgccccctcccggcaggcagctcaaaggctgagccagagagaggtgggcagagagggtccagctgccagactcagtcctccagccccttgcctccgcctcttggccaccgcttcccgttactcccttccacaagccccctcgcttgtttgtccccagtgcctgataattaggctgtgtttgttaaaccatgggctccagctctgcccacccagactctgcctactgtagattttcctgcaaggactgcagagatcataaaaacaactacccaccttgtctctctggcttatttactaacttggccataaataatcagggcaatttgcatattactacttggctttttatagcaccacacatctgagcactggcaggcaagctgggggttggggtgaggaggtgaggcacgctctgggctggcagtgacactggccagagctgtttctggcaggcttggcttctcctggcctgaaagcagagagaactagcctgggagtaggggcgtgggacgagggaaagccagtcatagtcacctagttgggacaggatgagcacagctgtagtgggagtgacaactccatttgccaaggatggcttgtgagctgggagaaacagggtcccaggctcctgcatcacataggagctgggtagagcacgggtgcacttcagactccagctctgccatttacttgctgtgtcaccccgggcaggtcacttcccctctctcatccttgtttccacacctgcaaaatggagatgacagtacctaccccagatgatctttgtgatgattcaatggggtgctatagggaaggcacttagcatgatgcctgacctagagcaagggcttgaaatgatgatgatgatgatgatgatataaaaacaaatcctctacattcctatagctatcaaacaaaatttatgaagataaataaaccaagacctaccccaaggagagggaagttgttgagctacagcgtgcaaggctgtggcatcagaatggaatatgtgaagggcccacagtagcagaggaagtctatatctaccaaggcagacgagacagggagaaggcagggtttagagctggaatcaccacctatgcctgttgtctggggatctgggtttggagtgagtgtcagctctgagggtctgagtgcccactgggctgcccaccctggttgaaaccgcacacctggccttcagcactgttcgccctactttattagggctggtcagccctggtccccagaagcctggaccctgctccccacaccccagccctgaattacatgattgctctaccacctgccagacatgaagccgttttacaagctggaagccatggatgctatatttttagatctcaactagccttgaaccttgggtggggcccttgtctaaaccaaactttaggacctgctgcttcttaggtggcggtcagtgaatgtcctaggcaaagaaacccagccctggtccccatttgcaaatctagagactgggccacttgctatgtctcataggacagaagcatgaggggtcatggcaggacacaagtaagtgagcaatgacaataatatccccaaggtcctgctaggctcaagggttccccaagtcacagctcaagtatttggtgacattatgaccctaaggtcactgctacacatgcaaaaggatggagctatcagtatcatcagaagtcaaggtgcttccagtgaccagcaaaagctacaccccaagggctgagaggggtggagcgagacccatgggcccttcttctgtgcctcaaaaggccaccaccttcctggctcacagctttttgctagatgtgcctccatctgacaccctcttccctcagccccctcattctaactgggtccttcctgaatactcaagccacccaagtaggttccccaggccatgtcaattctagcaccctatttctttccttcagaagcttatcaaatctgtaatcattctgtctgtttcctagtttatttactaatctcccttactagaggctaagtttgggagagatgggaatctgtgtattttgttcccccactgtttttgcgatgcctgttcaaccctgcagagtgaccacatggcccagtataattaacatattatatggtctccctcagtggctggcccctaacaggtgctcagtaactatgtggggaatgaatacgtgaatgaatgaatgaatgaatgaacgaatgaacacaagcagtaaaagtcgacattgtcagtactgtagcacaccctggatcctggtgggtaactcttgctttcctaattcccctgcccagatccctctgggctgaatccctgtcaaccaccactcccttggactcttgcctggctggtcccatctcatctgtgttcattcaaatgtccctttcacccccaccctgctggaccatcaggtcatcatagggtcacctctggcctgacagaagccacagccatggctgcgattggctccttggatttcatcacatttgtgacctctagaagagagggaaagaagaatgccaggaaggcacagggtgccaggagctgaggatgagggccaggaatgggaaaggtcaacaggagtggatgccacagaggaaaaggaggaccagccaagaacagtcccctgggtcaggggaatgaacatcctaagaagaggatctgcaggcaaaggaggctctgaaacatgactgcaggcagctaaggaacagacagtaggattcagtttgggtaaaatcaatgcataagtgtgtgagggtgtgttatcagtggttctttctgggtgccaacatgacagctgacttttaaaaattcttctttatgacagtcttcattttccaagttttctataattagaatgtatttatatactgaaaacatatatatcaaaggatgggaaggagaaagaccgggaggcggaggatgcagggcccctgggggaggacaggcaactgcggcagcctggggggagctctgaggctgccttgccctccccagcgtacctcgcccccaggcatcctggaattccttctcatctagagccaggattgctcagctcccaggcaacaaatgcaggatttgtgcaagtcatggggttccctgtttccttttttttttttttcttctctcttctactttgtattttgtaagaatctaattttaaattctccagatgccatatttttgatcttttcaattgattctttgcagaaatggagtaaccaaaatgtcatgaatccctttaatggaaaaggataaaaaggctgtgaaggcttggaaagcagtcactgtccagtcccctctcagccaggcctcatcttcgtggtccctgttcctcccctagccatgcttctgcctggtggttgagatgcacaaaggccccacccacctgtatcccctgggtcagaaaagttggctttctgtcacgactggagacagctattgcataagagaccataatccgtagccgtggaagagtctttggcacaaagggaagctcgcacttcccaacccctgcagcaagcttgctccaccccaaccctgcctgggacattggccaatgtctgagaacatttttcttctctgcaatggggagaggggggctactggcaggccacggttgctgctaaatatcctacaaggtggaggacctctccttacaacaaagaaactccatagtcctgaatatcgagggtgccatggtgagaagcaggctggacagtgtgccaggctctgtgccaggcccttgtgtgccacatctcactctgaccacaaggcagactgtgctctgatggctgtccatccttggctgatccagactttggattggccccgtttcgcaacggctggagcggctgggacacagggcaccaaggctgcctcaccatggaagaccatgcccctggctcctctctagcacccagggccaccactcactgcttctctgctatctgtgttctgagtggggctcaggggctcaactacctgactcatgggctcaaatcccagcaccaccacttatgagttactcaatctccctgagcctcagctcctcatctgcagaatggcaacacctatttcacagagttcttgtaagacttaaaagggttaatatatgcaaagtgcttagagcagtgcctggtacatagtaagtgctcaataatagtagccattaatattatcaatattattactcagatgagtgaaagagattgctgggcaccatagctcatcgtgactgcaatgcatccccatcatcacacacaaaggcacaggcttccgtgctggatcctacaaaacctcctggaggccttataacctgacaccattattgccgtctatgcacatggccctagaggttgaaagcattatcttccttttccaaatgaggcaatggttgggtcagctcagctagggtaattgcttcaagcctctccatatctgtgtatgggatctgtgtatgggatccccagatcaggtcatcaggatgggctaagaccccaatgtcatgagtgtgctggcttcccctctgatggggagtccagcaggatacatgtggctctttggactcttaagttctttatgaacttggtgaatataaaatcagcaagagcacattttaccacagcccttgaccttgctgggacccaggtgctggcaatagctcaaagcaaaaccagacaagcacccaccaggccctctgagactctgcagaggcattctgaggtagcatttggacccagcctaaaaataaacccttaagccttcaactatttttattaccaagtaacacatgtcattgacatccatcaggggtgtccatggtacacacgactggtagcaaaagagtagcttataccttctgacagtcactttaatgtggatgccttaaaacagacaagccaggaagtcccgctgtggccatgtttcaggacatgcattcgagctggcagtgaagacagggggtacaggaaggacatggaggacagggaaggtggtgaagagggcagagggaggggctccgggggcaagaccatgagcaagagatcccaaggtgagggtccatcccgagggtgggacagccaggcaagggaggacaggatggccagggggagcctccaacatctgtggctgaacctggctcttctttggcctgttctgctgaaaggcctccagccacacccttgcttctgctggtgtttgagactctgctctctgatgccacaactgacagtccctggagaagcaaagcaacagaactggctatagaaacctatggccaaacccttatgggcaagaggagtgtattagtccgttttcacactgctgataaagacatacccgagactgggaagaaaaagaggtttaattggacttacagttccacatgtctagggaggcctcagaatcatggtgggaggtgaaaggcacttcttacatggcggcaacaagataaaagtgaggaagatgcaaaagcggaaaccccgataaaaccatcagatctcatgagacttattcactaccacaagaacagtatgggggaaaccgcccccgtgattcaaattacctcccacctgatccttcccacagcatgtaggaattatgggagtacaattcaagttgagattggggtggggacacagccaaaccatatcattccaaccctggcccctccaaatctcatgtcctcgtatttcaaaaccaatcatgccttcccaacagtcccccaaagtcttaactcagttcagcattaacacgaaagtccacagtccaaagtctcatctgagacaaggcaagtcctttctgcctatgagcctgtaaaatcaaaaagcaagctagttatttcctagctacatggcggtacaggtattgggtaaatacagccattccaaatgggagaaattggccaaaacaaaagggttacagggcccatgcaagtccgaaatccagatggggcagtcaaattttaaagctccaaaatcatctcctttgactccatgtctcacatccaggtcatgctgatgcaagaggtagattcccatagtcttgggcagctccggcctgtggctttgcagggtatagccccactctgggctgctttcatgggctggcattgagtgctgcttttccaggcacacactgcaagctgttggtggatctaccattctggggtctggaagatggtggccctcttctcacagctccactagatggagctccgatgggtgctccgatcccacatttcccttctgcactgccctagcagaggttctccatgagggccccgcccgtacagcaaacttttgcctgggcatccaggcatttggatacatctgaaatgaggttaccaaacctcaattcttgacttctgcacaccagcagactcaacaccacatggaagctgccaaggcttggggcttccaccctctgaagccacagcatgagccctatgttggcccctttcagccatggctggagtggctgggacacagggcaccaagtccctaggctgcacacagcatggggatcctgggcccagcccacaaaaccacgtattcctcccgggcctctggggctgtaatgggaggtgccgctgtgaaggtctctgacatggcctagagacatttttccattgtctttgggattaacatttggttccttgttacttatgcaaatttttgcagccagtttgaatttctcctcaaaaaatgggtttttcttttctactgcatcatcaggctgcaaattttctgaacttttatactctgtttcccttttgaaatggaatgtttttaacagcactcaagtcacctcttgaatgctttgctgcttggaaatttcttctgccagataccctaaatcatctctctcaagttcaaagttccacaagtctctagggcgggggcaaaatgtcaccagtctctttactaaaacataacaagagtcacctctgctccagtttccaacaagttcctcctctccatccgagaccatctcagtctggaccctactgttcatatcactgtcagcatttcaaagccgttcaacaaacctctaggaggttccaaagtttcaaactttcacagattttcttgtcttcttctgagccctccaaattatttcaacctcttactgttccaaagttgcttccacattttcgggtatcttttcagcaacacttcactctactggtaccagtttactgtattagtccattttcatgctgctgataaagacatacccgagactgggaagaaaaagaggtttaattggacttacagttccacatggcgggggaggcctcagagtcatggcaggaggcgaaaggcacttcttacatggtggcaacaagagaaaaatgaggaagatgcaaaagcggaaaactcggataaaaccatcagatctcgtgagacttattcactacaacaagaatgatataagggaaaccacccctatgattcaaattacctcccaccaggtttctcccacaatatgtgggaattatgggagtataattcaagatgaaatttgggtggagacacagagccaaaccatatcaaggaggcttcctgaaagctcttctttcccctaggccttcctttgctcccctcccccaaccccacctcatgatggtctcttaactctgagagtgtcttacagacagcttgaaacagacttcttcttctctcccatgtccagctctgcctttgggtgcaccaacactttccttcttcgccccactctgcctttttgctctcaaagatagggccgaattgttgggtatgcacagaattcattatgccaaactgcagactccatcaggcatgggctggggtccaaatctccaaaggttcaggcagtaaaacagtccagaagcacacattctaaaccatccccaaaactgccccttctctccctcaggcctatgtctacaagggtaccaccagccctaagcagggccggctgcacagtgcacagagcactgactttggaaccagcagagctgggttttagttcatctctggtgcttactagctgcttgagcttgagacaatgacttgacctctataaacctcaattttcttatctgtgcaatgcgggtgaatggaaatgttatggaaatgttgtaagcaaggtaattcatggaaagcctttagcactgtacccaggacacagtaaatgctcaaaaatagtttaaattcctattatcattattgccatctatatgcacaacctctaaatcatgagttgttaccctggggctcaaagatgagtttcaagtagtttgtgagtccacccatagaaattaaatgcaaaattttagttcaatgtgtgtatattatgggagagagtccctggctgtcatcagaagttcagagggatccatatctccaccctgcccaattaggaacttgagacagtattacagaatggtcaagacataatggtcaactctgaagtctgaccacctggatcagccagctgtgtgaccgtaggaagacacttcctccctcccttccttcagttcagttgctatttgtaatatggggctaatgataatacattccccatagggctgctgagaacactcagtgagatgtagcatttcaagctgagaagagtgctgggtgcaaggatgtgttatatgtacgagtgttttttatgcagacacatacacacagcacacatactaatatatacactgcatatacaaatactgtataagtgctaatttttatgatcaggaagcgctgttccaaagcctgcagttgattcatcccaccctactcgttgctcattccctcctgcatccccctctctgccttggaatttcctttccctcggaatttcctctccctcagcgttccctgatcctttgcatcttgaaacaccaacaaagtcagcagaaataatgggcagagaaaggaagaggggaaataatcaaagtttggggctcagaaaccagcctagtagaggggggatgccatgaagctcgagctgcaagtcttgggagctgctaaggccctgggggctggctctgacgtggagttagaagtcagggtctgagtccagctgcagagacaagtgggctcaagagaggcaggtggagtcttgccctagcctagggaggcaggggtctggcgggcttggacgcagcaggatgtggaccagccagggggttgggtacactgcagcacagtaggcatctgagtgtcctggtcctagaatgctcagtcctgtgccgctctctgggaaagatggggcttctccacagtcaggatgggcttggggtctgcaggacagacagcactatctgcagctgagcaggaatggtggagagcgacactcaatcatcaaattagaaacatcacaaattcctggaaatgatagtgaagcaattctgcttggaaggggacaggatcgatggtattggcaagcctgtcatgccctcgcagattcatggagaaagttgtggtgcctccctcagcctgcagggaaggcacaggcgaggatgaatgcccgcaccagggctgtaacaggcagccagagaaggctcgcattgagggatggactccagatacaagctccctcatacatgagttatcccaatgactcacagctctgggtagtgattagagggaaaactattgagaaatatatatttactccagttctacacttgagaatgaaacacacatcattagccataaaagtaggattaagacaacagagcattatttgcaaatgataaacagacatgggcacagatttaaacatgtacaaaagatgtaaatctgagcaaggaatgcttagttctattgctactgaaggcagttcttatgtgctgcctggattaggtggggggtgcattcttacatggttactctccattcaacaaactctacaaaggatgggccaacggcttgtacataagaaaccaatattctgccattctagggagccaggagccccaggggctgccaggaagagcctcagggattatcctgactagtccatgagccagtagcaccagcatcacctgtgagctccttggaaatgcatctcagactgaatctgattgtgcacattcacaaattcccagctgatttgcatgtgtgtgaaagtttgagaagcccctttccagagcagtttgtcaaccttttaaaatcagggaccccctatgaagattcacataaaatgactgcctccttcttcaatgtggtttaaaattcaaaataaaatgaataaaaacaagtcaaagtaaaggtcactctgaagatgctttttcaaactgcacacgtacctcccttctggctcccacttacaatatgtgatgcaagaaccactctccatgactccaggaagtcaggattggggaggcacatccccaggtaaagaatgactgacagagagctacagccccactgtgcagatggcatgtctgtagcccagagaggtgcttccctagaagccccaacttctgcactggtgcttcctgagacagggaccctcagttctagacagacacaagtgttagaaatgacttgaagtttgtttccctggaatgtacatttcacagcctgagtgccaccatcttatgtcagcttttgacaacagtcgtcatttcccctaagagtctccttccttcaagtgaacagcctgaagtcctcaagatccatcttgcaacataaagtccttcctcatcctggtcattctcccgtggtcccacttgagtttgtcaatgtccctctttgggtatgggtagcaagggatatacttaaacttttctcttttcttttacatttaatcttacattaatcaaaacatgcattcttattataaaaacaatgtaactatgttgcaaaaaacttttcaatacaaaagattaaaaaattattcataatcaagccatcctcatacccatgttattattagcatgttgctatatttccttctagtcttattcacctgtgtatacatgcttacatggtaatgtacataataaacagataattctgtagcctgttttgttattttttaacttaaacattttttatgctgcagcagtcttgacaatcattagcttcccattccagtgtgtaactgagaactgaactcagttccccaagatgttggtaatggtttggctgtgtccccaccaaaatctcatcttgaattcccacgtgttggggtaggaacccagtgggaggtaattgaatcatgggggcaggtctttcccctgctgttctcataatagtgaatgagtcttgtgagatctgatagttaaaaggggagttcccttgcacaagcttgctctttgcctgctgccatccatgtaagatgtgacttgctcctccttgccgtctgccattattgtgaggcctcctcagccatgtggaactgtaagtccattaaacctctttcttttgtaaattgcccagtcttaggtatgtctttatcagcagcatgaaaaatggactaataaagatggtttgaccagttcagaggaaaaagagaacagtttctccaccaatgctttcacatggcagcctgcatgacattgttcatcttgcaccccccagggcctcataaatgtggcaactctttggaaccccttcttttactctgtactggtgtcatctacttttagggaggcctaaatatacagggtattcaactatttattcattcattgggcaagaatttgctgagaccccccatgtacaaagcagtgtgctgaggtctctgtctgcagtggtgaacaagacagctctggtcccgtgagttcatggaacttttatggtggtgacctcagcaaagcaacagagcacaggaagggaaagagacagaaatccagtaagaacccatcacaggctaaccgtgggtgcttggcttgcatacatcagctcaaagaatcttcacaactcttttgcattgctgatgaggaaaaagcagttcaagggtacttgtccaaagtcaaagaggtagtaaatggtaaaggcaggattcaaccccaggagtgcctgactttaaagctctttctgaattccctaaattcacatggagactataagatgctctttctctcctgaccctccagtaagctctagaaattttagaaggccattatgagacactcccaacaatgtgcttcaattatttcataaaagaaagacaaaaataacagaatactgcctggtctcagaggtgtgattagatttggagaaaggaggggaaaggggaccttttctgcagaagcacatccaccaggagcatgatttagacaaaagtgtgatttagataccttatttttcatttgaccagccaacaaacatttgtgcaatttaaatcttttcagaatgactctgacaaccaagtatccacgggttgactcagtctgcttcttatcaccatcagactttgaaaactccacctcccccttcataattactccaggcaatcagcaccaactgatcaatcaaacaaagaaaattgcaggtttgaagctttaattaaatctatccggcactatctaattaaagaaaatctttactcttctacatactccaaaatagaagaagcccactcctttggggttctacaaataatttgccactttgaggccttcacctaacttacactggaggaagagtgcagtggagaaaagacagccattccctcttcctttacttcttgcctaagtgcaggcaaattccaaacatggaaggagacaggactgtagaatcccgtctctggtaggtttcctctcatctatctctgtcctttagggtagatgggtcctttttctggctgactgttgcccaaggcctttctcccgccctccacaggctcctgtggctggagggcactggctcagagcagggagaaaatgctaagaactcagccacaccttcttagcatagggcttatgagccattctgaagctcagctttctcctctgcaaaatgggatgaatatgacacttcaattggattgttgggagaagtcaataacataatgcgcctgagaagccacaacaatcaaacggaattgagaggagtaacactgggcacttacatgggtggagctttgcggtagtggatacaaatctgcctctgtctgcaagaactctttgtgtctgcattcccccacccccacccttgcagaccaaggcaggtttgaaaatatccactactgcaaggcttcttgcagaactagaaagcttctttattgtccagatttctttatctctggatggtgaggaattcctcttataactgaaatccagctaaactatcagagccaagatgcgtccccgttcctctttactttgtagggtttacgtaagtttaagatttgccttgtctttgatatgtagctgtggaactttggaggagggagaagttgtatgcagctctaccagcttgccagggcatcacaaaagcccctagatccctagttaagagccctttgggttaaaataatcaaattggaaggtggagtcaattgttcacgcttccttccttatgagacttaataaggcagccattgcttatggaaggacaaaggtggcagtgatgatgcgagagactgaactggcacagtgaaagactgccaggtgcagaggagctagccactataaacttcgtgaaaacatctgctcctccaggcaggattgaagatgctgcattgccagtctgcaagatgctaggggcatcacgtggtcagaaactgcttccatgaattcaacagccaggctagtagtctatactgtctacagtgtctttaccatgtcatctaggcaaacccagtcagctgcagctcctggggcaactggtgcagtaatacgtgaggtctaagtttacataaaagtttatttctcacttatgtaaaattcaatcaatcagcagcagataggggaggaggtgggttctgctccatgcagtcatccaggcatctaggcttctctcatctcctgtcccagggaaagatagaaagagaggattgcagaggaggctttctgcccagacctggaagaggcacacatcatttccatctaccttccactaagtcatatggctccatctagatgcaagggggcctaggaaaatattgtccctagctaggcagctgcttcccactaacacctacactgtggaaaaggagcaagattgatggtgggcaattagccttctctgccacactgcttaacgtgccattggaaaataaactgttcgccaaagacaactgctggaattgctgaaacagccaagagcagtacctacgtagagtagaaagaatcccagaagctcagggatattttatagtccttctatatgcatctccagcatcattcaatcacacaatttcagagctggaagaagctttggagttcctctagatttaaatcctcatattgtaagtcaggaaaacgcagatggccctgagaaggaataggacttagtgaagatcacaagcaaaccagtggccaagctgggacagaacccagctctccatgcccctggtctggctcttggcaccacatcttgtgacagagtagaaattgatgcagtagcaaaaggctggcctcactgtttatgggtagttgtggcagtagacccacttaagggtacaataatttggctcttttgtcacttaaaagtcgagaattgatttagttttagatttactttaattccaagagaatgagggactcaatacttgggaagtgtttatttgggtaccgtgtctgctgaaaaagaaacagagggaagactagaatgacaagtccaaacctgcctccaccctgcagacaccagggtcccttgaagagcaaattctgtggccccagaagttcagggagtaagagctgaggatatagaagggggaaacttcctatctcagcaacagtgctgtcagcagccacttggaagagaggggccgatgaggatctagaggtggccaagtctgctctaggggaatgttgcgtctttgaccaatatctcatgatactgcaggcaggaccaattgtgagaagtgatgcaggcagcacagccttttggactgagactctggctccagggggtgttaaattttggctgctattaaacagcagacttggtgaatgagcaaggtgaggctttgccacaaatattgattttgaccttgaaccacagggtcctactgtgagtggagagattgctcaggaccccgacactgctgcccacctggctttgtgtatcacctgctgccaacccctcccccaccacgtctgcccagaccctccctttggcattagggatggagcacatggctgccccatggggtcactgcagttggtttccagagcctcatccctggcagaccccactcctccccttccataacccccttcggtgctggtcaggtggtgctgacctgtgtgaacttggatatcaagcagataccagggtcccaggtatccagcctcccactccaaagcctgctttggattgtgaaggaagcagactgcagtaaccccacaaaacaggccacttccctgtcccaagaagccctgcccagcaatgatcagcgggttttgtcttctgcacccctcttcctctgcctccttattaaccacagctaactttcctgattaactacacagctcctaccaacaggtttgcctccggatggcaaatttgccagcatttagggtgaatcaaacatatttacttttctgatgttaggggtttgataaaatccataatgcctttggcctcaaacccacttcctattaattattaaacccttgtgtgtttcaagggtaattgaatccatgtttctaattagtttacacttaattcatcagaacaatttttaaaggtctgatggatgtcccaataagcctcatgggcagtttaatgaatccttatttaaaaagaaattggacacacaccaaactgttaacagcggttacctctagggagtgaggctgggacaagggcctgggaaaggaggcagctgcatttttctcactctatacactgctgaccttcttaaagcagaaaatacctattacatttactattttagagaaactgcttaaaaaggaaaaaggaatggatttttaaaaggaaattgaatgaatgaatgcaaataaatccaaagcaatgaaaaggcattttggtatagtgggggaaagccttgtttctggctctaggagacccctggcccacccctctttagccactatgttagtccattcttgcattgctgtaaagaaatacctgagatgggacaatttataaaggaaagaggtttaattggctcacagtcccactggctgcacaggaagcatgatgctggcatttgcctggctcctggggaggcctcaggaaacttacaatcacggcataaggcaaagggggaataagcacatcacatggcaaaagcaggagcaacagagatggggcaggtgccccacacttaaataaccagatctcatgagaactcactcactaacgtcaggacagcaccaagaggatggtgataaccattcatgagaaatccgccctatgatccaattactacccaccaggccccacctcccacattggagattacaatccaacacgagatttgggcagggatacagagccaaactatatcagctatttggcagcttaggggccttacatgcttgcttaacttctgcaaagagaattaatactacccacctcctaaaggtgttgttgaattattagataatgtgaacaatgtctatttaaaacctttcattgtgaaccatctttcttagaaatgtatcgagctcctcagcagggcatacagggtccctggtggagctggcccgggccactgctccaccttcccactatacaccagccaaaatgaacctacccattgtcattctgcacctcacctttctctcacttttgcctagacctatgcacatactatttcttggctcgaaacactctcatccctccttccacactctattagggatctcttcctccagagagcattgattcattcactccataagtatttgtttagcatctgctataagccagactctctgttaggccctggagagctacaatgaaaagtaaaagagaaagagttcttgtcatcaaggagtttacagccttgtggggtagatgggcataaatgaagaagacacacacacacacacacacgcgtgtgtaaaaccacaaagggtgaatgcatggtaatctgagcaggtatcacaggagggtttgaccaggttgtgaggaaagggtgtcctgggcaaggaagggacaactgagttacttgaggaatgagtaagggacaactaagcaaggggcagatggagggggttcatcccaagcctccagatgagcatccacaaagatctcccccaaggcgaggtcaggttccccagtcatagcacttataccctgattatttaactgtctccctaaagatatcgttaagttccttgaaggcagaagctgtcttgttaactgttgtgtctctgatacctggcattcctgttaggcattcaataaatgtagaataaattaccatgagagcatgaacacaagtgtccagcatggtggctggaacataatagccgttcagtgtcctcattcctttgttctcctttccagtgtcccctctctgtttcaatcctgaacaaagacttttccctcatccccatgggtcctcccagcctccttctgcccacaagagcacattcccagaggcattctggagagcagacccttcaaggacgtccctattgatgtgcaaggcacaccttttaaggaatccaaaaaacaggtcctttgggggcctctgctgtgatacatattcataagaagacagtaaatctggcaaatttgtggatttttacaacttccaaaacaggtgtctgacgccagttgagtgaaatctgcaactagctccaaatgactaaaactacattgcaccttaggctgatgacagaatgtgtatttccaataattgagggaacgagttgtagtgtttcccataacttgagcccaaatgtctaaattaagagatgcttagctgtgcttaactggtgcagtcatcaccagcaccctataaaccctccaatatacgggatgcagtttattagcagcgtcttcatagattatgtttgctcgtgtcccattagaaaacttcattccacattaaactgcaatgcaataggatgtctgccagcacggagaggccatctaattgtgcaaaagcagagacgtggggattgtttcagtaattcatccaggcagggctgacactgcattatctggaaggctctttgttcttttcttgctaatttccaaactcctacaggctcccggccttcaggaccagctcctactcccgttccccaccctgatccattatgagaagaatctgatcagcttctattgtaaatttaatttgaagcagccagacgctgccttctggcaccctgggatgtggttgcttgtgaatagctccagatgaaatgtgagatgctttcaaggagatggctatgaactcctggtagagaaagggagtcattgggagatgaatagcatctgcatatagaacaagctgtgcgcagtgtgtctattggcaccttctcatcaatgatgccaggtgaagctgccagtacatagcatcagtgagaagttcccattttgctgagaaggaaactgaggcttgaatgggttgactcacttgcccaagttcacagacatagaaagaggagtaaaacccaggtatgtcttatgctaaaggtatgaacctctcaaatcaatccacctcacggtttttcaacctcagctttactggcatttggggacagataattatttactgtagacagctgtgctgtgcattgtgggatgatgtttagcagaatccctggcctcaacctagtagatgtcatcagcacctctccacttgcagttgggacaaccacaaatttctccagatgtggccaaatgtcccctgggggacaaaactgccttcagttgagaaccactgctctacctcatgattcacaaattattttgtctttttgctaaatagtgctttctaatttttcctataaatgtaggagtattccttttgtttctatctcatcataattaaagcagtttacatactgttttaatttaatcttgatcaactaacctataaggtagatcttgatacaccccgtttatcaattagcatactgtggatatcagtgaaagtgacttgccaatgctatgcagctagggaggagctggagagcaaactcatgtcatctactggcaagactggtgtatattccactgtatggctctgttacagcaaagcaaaaaaaaaaaaaaaaaaaatatatatatatatatatatatatatatagaaggcttgactcccatgactcccagccttaaggagcttagaatctaataggaggaaagttcatttctcacaacacaatccaggagcaagcagctggagaaaggtgaggttaaagggggctaggattggggtagggaggtaacgtttcagccttttgttggaacgcatccataaagaaagaagaccagagtgttggagagaagagaagagagatgccttaaaaatgcagtgaggtcacgcctgtaatcccagcactttgggaggccgaggagggtggatcacaaggtcaggagatcgagaccatcttggctaacacggtgaatccccgtctctactaaaaatacaaaaaattagccgggcgcggtggcgggcgcctgtagtcccagctactcgggaggctgaggcaggagaatggcgtgaacctgggaggcggagcttgcactgagccaagattgtgccactgcaatccggcctgggctaaagagcggaactccgtctcaaaaaaaaaaaaaaaaaaaaaagcagtgaggacactttgggaggccgaggcgggcgaatcatgaggtcaagagatcgagaccatcctggctaacacagtgaaaccccgtctctattaaaaaatacaaaaaattagttgggcgtggtggcgggcgcctgtagtcccagctactcgggaggctgaggcaagagaatggtgtgaacccgggaggcggagcttgcagtgagctgagattgtgccactgcactccagcctgggccacacagcaagactccatctcaaaaaaaaaaaaaaaaaaaaaaaaaaaatgctgtgaggagactccaaaagggaggagtttgggaggcagtgagggttgaaaaactgcctattgtgtacagtgctcactatttgggtgatggatacaactagaagcccaaacccctccattgtgcaatgtatccatgtaaagaaccagcacatgtaacctccgaatctaaaataaaataattttttaaaatgtagtgaaagcagtaattgcaaaacttgtactcatgaaatttttttttatttttatttttcagagactaggttttactgtgttgcccgtgctagtcttgaattcccaggttcaaacaatcctcttgcctcagcctcccgagtagtagctgggactacaggtggatgccactgtgcccagctcattaagttttagacaataaacatggaaatcccccaggtgatgcaggcagagaaaaatctgctgcaggcctcttggtggtctggccccactgtctgtgtgggaagggagaggagaggaggctatcatgggatcagtaatgccatgatacgtacacattacatacatacacatgatacatacatgcacaattaatgactgttcctgagctcagtgactccttcagtgtctttctaccacacctgaaattcccagtctaaaatgtctgatgagttggccacagatgaagtgtcatcacaggcactagaactctctggaaaggtctgagttactgagtcctaagaacagaagggcaggaaaggacgtaaacaatgtttccggaccacgtaagcatctatagctggtggctcacatacaacaaccctgtaaggcgggtaaatgtcacctccattttatagatgaggctcagagaaaccaaaccttgtatgaggtcatagcattaataaatgtagagcctagctaggtataaatctaggtctgtccccactgcacccttctgtctcacaggaaaacactgagacaggaggtgacctacctgctctatctaccagacaagtgaagaaaaatgtcagtgcagcaaatatcctggtaggccccaagaacacatttcactggagactgaaattcactgcagactgatttggtttgttttctgtttccaaggcagacactgcggagtcatcctccattcctttctttttcttactcccagtccactgtccctatacatccactactaactctggggataactctttcccatagcatcatacacatccatgccatctttacccttcattgctttagtccagactactgctgtctctttccttgccccacggtcgccagtctgccctccaccccagtgcattttccacactgccaccaaatcatgccaaaatcctctgcttaaaaatttttattagaagggtatccacaaaaaacctacagataacatcatacttaatgctaaaagacgaaatgtttttcccctaacatcaggaataagtcaaggctagccactctgaccatttctattcaatattatactggaggttctagacagcacaatcagggaaaaaaagaaataaggggtatcccgattggaaaggaagaattaaaacttttattcacagatataaacgaactgaactaacaaattcagcaaggtcacaagatacaagatcaatttacaaaaatcaattgtatttctatatactaacaatggctagtccaaaaacaaattttttaaaaaacccattcacaatagcatcaaaaagaataaaacttttatttaaaaaatttccatgtcaagatgaagaggaacgataacatgttaaactctgccttgcctgaccccctaaattctcatgaaaatgatctaaagtatataaagagatggaatatctacattaactttggaaaccaaggaatacagatagatacctacatgctacaaacacgaagaaaattctacaagatagagtcagtaagacctacctaagacaaaagctagctaggcaggatgttgacagaaaaatacagcttaaaacatgttctaaagaagcaactttaagcactaatagaataaaaatcacagaaaaaacaaagacaacttgcactagaagacagataaaaggaagtaacagtaaggacgcttaaaagtaatagaaagcattaagtataatagaagagcaaacatatcagttgttaccaaaaaatatgagtgaactaaattttcctgttaaaggatagtgactcttagccaggattttttaaaaatttaactactgtgtatattgtgctaagaactattcctaaaacaataatatagatatattaaaaatagagaaattggcaaaaatggacccaatcaatgcatatctgaaagaaaaaaagagtgtaatattggtacaaagtagaatgtaaagcaaaaaaaaaaaaaaaggagagaatagggaataactacaattttcatattggaaatatatatatacatatacaaaattcactctgaagatctaatgtttgaaaatatgaatgtgctgaagagtataggatcacagtatataaaataaaaacttaggaataaaaggaggaactgatataaactatagtaagaatgtgagagcaatatattgcctatccgcaaatatcagttaggcaatagatatgaaattagaaaaactgaatgatattaataacataattttttcacctttcatacacagaatatctttcttcatagaatactgacaaaaaatgatcttatacagagggaaacaagtcaacaaattctccaaagtagaaatcataatctaatcataatgaaataaagctagataataatttctaaagtataaacaaatattacttcaaaatttaaggggaaaaccctagagtcaaagaaagaacaaaattgcaattagaaactctttctaaaataacaactagccataaaaatttatggaatgtggtcaaagctatacttaggggaaaatgtctcttaatgtttttattatcaaacaagaaataataaaactaatttaatttacaaaattggcaaaagaacaatattagcctaaggaaagtgagagaaaagaatagataaagataaaagcagaaatcaataatttagataaaagagaataaaatggatcaccctagcattggaactttaaaaagaccaataaaataggcaaacttctggcaagactaactgagtggaaagaaagaaagaaagaaagaaagaaagaaagaaagaaagaaagaaagaaagaaatgcacaggagcagatgtgagaaagggatgtgacccagacaccatggagaaagaaaggttgagtgggaaaacagtgtacaaccttaggataatagacttgacactctcaataaaatgggtgattttattggtgattccctggactaacacacacacaaaaatgattcatgaataagaaggaaatctcagtagattaaaaatcatgcaagaacattaaaaaaaaattcacaaagacccaagggtccccaccaagcatgcttgctgctgcctctccacacccccagagtagcaccattccagtatcaaggacagcatcttccaatgttacttggactgtcctctaaggtcatttcccctcctatcatcctccgaggtgtgagctcctctggttccaggtcaataaaaggcagtggtcgtccctctccttccccctccccctccccctcccgctccctcttcttcgtctcccgctttccatggtctctctctgttgccgaggctggattgtactgccgtgatctcggctcactgcaacctccctgcctgattctcctgcctcggcctgccgagtgcctgggatcgcaggcgcgcgccgccacgcctgactggtttttgtattttttggtggagacggggtttcgccgtgttggccgggctggtctccagctcctgacctcgagtgatctgcccgcctcggcctcccgaggtgcctcgctcactcagtgctcaatgttgcccaggctggagtgcagtggcctgatctcagctcgctacaacctccacctcccagccgcctgccttggcctcccaaagtgctgacattgccgcctctgcatggccgccaccccgtctaggaagtgaggagcgtctctaactggctgcccatcgtctgggatgtgaggagcccctctgcccagccgcccagtctgggaagtgaggagcgtctcttcccggccgccaccccgtctaggaagtgaggagcgtctctaactggccgcccatcgtctgggatgtgaggagcccctctgcccagccgcccagtctgggaagtgaggagcgcctcttcccggccgtcatcccgtctaggaagtgaggagcgtttctgcctggccgcccatcatctgggatgtggggagcgcctctgcccggccgccccgtctgggatgtgaggagcacctctgcccggccgccccgtctgggaggtgaggagcgtctctacccggccgccaccccgtctgggaagtgaggagcgcctctgcccggccgcgaccccgtctgggaactgaggagcgcctctgcccggctgccccgtctgagaagtgaggagcccctctgcccggccgccccgtctgggaagtgaggagcccctccgcccagcagccgccccgtctgggaggtggggggcgaccccgcccagcagccgccccgtctgggaggtggggggcgcccccgcctggcagccgccccatctgagaggtgaggggcgcccacgcccggcagccaccctgtctgggaggtggggggcacctctgcctggccgccacgtctggggggtgggggggcccctctgcccgtccaccaccccgtctgggaggtgtacccaacagctcattgagaacgggccatgatgacgatggcggttttgtcaaatagaaaagggggaaatgtggggaaaagagagatcagattgttagtgtgtctgtgtataaagaagtagacataggagactccattttgttctgtactaagaaaaattcttctgccttgggatgctgttaatctataaccttacccccaaccccgtgctctctgaaacatgtgctgtgtccactcagggttaaatggattaagggcggtgcaagatgtgctttgttaaacagatgcttgaaggcagcatgctcgttaagagtcaccaccactccctaatctcaagtacccagggacacaaacactgcggaaggccgcagggtcctctgcctaggaaaaccagagacctttgttcacatgtttatctgctgaccttctctccactattgtcctatgaccctgccaaatccccctctccgagaaacacccaagaatgatcaataaatactaaaaaaattaaaaaaaaaaaaaaagaaatcaaggaagcagagatagaaaacataggcagctctttggagaattgtctggcaaagggagcagagaagtgaggtggtatttgatgaagaatgtgtggttagatcacacacacaaaaaagtgcagcatggaaaatgctgctaggactcatctgatagaaccagagaggctgagatgtaggaaagaggggcccccaaagaatcttctagctctcgctctttgtcactctctgttcaaccctatatatctgtgttttaagtgatgattttttcccttattttgttcattgttgtaaattaattatgagtggaacattcaatagatttctcaaaatcaaaattaggttcatttttcctaattcaacttctcagtccactgaaatattatttatccctgggataaagttctggccctacttaaaaatgatctgagcttgggcaagtgacataactaagtttgctacagtttcattaaaataggcttaatagtaacacttaaccataaactgttttaagacttaaatgacacactagtagaccgggcatggaggctcatatctgtaatcctagcactttgggagatggaggcaaagtggatcacttaagctcaggagtttgagaccggcctgggcaacatggtgaaaccctgtctctacagaaagagtgcaaaaattagccaggcgtgggggctcatgcctgtagtcccagctacttttggggctgaagtgggggaagtgcttgagtccaggagacagagattgcagtgagctgagattgcaccactgctctccagcctcactagtaaagcatgtagaacaatgcctgatacacattaaagactcaataaatattagctgttgctgtggctattgttgtcatcatcaatcaaaaaaaaaaaggcagtggtctccttctagcccttcccctttgctaagcccgtgtgaaatgaattagaataagcagatcataaagatgacagagatcaggagcacaagcagggaaaacccaatgaaggttcaaccccagagcctcatcctcatggctggttggccaggaatgctgtgccgtggctggggacacatctgattcttctgcatcctaaggacaagaggaagccttccctgccagaaccacttctccaggtcatggaaactcccacccttccatgctagaacacaggccagaccagtctctgctgagtcttccatacttcctctcagagtcagaaaacccaagtgtctaacaccaaaagcaatggtaacaaaagccaaaattgacaaatgggatctaattaaactaaagagcttctgcacagcaaaagaaaccaccatcagagtgaacagcaacctacagaatgggagaaaaattttgcaacctactcatctgacaaagggctaatatccagaatctacgatgaactcaaacaaattgacaagaaaaaaacaaacaaccccatcaaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccgttactgggtatatgcccaaaggattataaatcatgctgctgtaaagacacatgtacacatatgtttattgcagcactattcataatagcaaagacttggaaccaacccaaatgtccaacaatgatagactggattaagaaaatgtggcacaaatacaccatggaatactatgtagccataaaaaatgatgagttcatgtcctttgtagggacatggatgaagctggaaaccatcattctcagcaaactatcacaaggacaaaaaaccaaacaccgcatgttctcactcataggtgggaattgaacaatgacaacacttggacacaggaaggggaccatcacacaccagggactgttgtggggtggggttaggggggagggatagcattgggagatatacctaatgctaaatgacgagttaatgggtgcagcacaccaacatggcacatgcatacatatgtaacaaacctgcacgttgtgcacatgtaccctaaaacttaaaagtacaataataataataataataataataaataaataaattgtacccttccacactaacaatgataatcacgtttgcattatacataattattttcttttggtggggggaatatgtggttttctttgacagcacaatcagaattacattatggcagactcatcacaaatgtaggtcaaaaacagttcaatttcctgcaatagttggtagtcaattctaaaacaagatggtgagaggagacagaagattttttgaggtttagggggaaaagagctgaccatttgaaagtgagatatgaacccctttctttgtttaattctggtatacttatttttactgctgcttaactgcctattatttaataaaaattagaacgtcattttatttataaacagacttgtaaacaaagtccatctcttggtcagttagtttataaatttgtctgaggtgaacaaagactctttacttcttccccactaggaccacacaacaaataccacaaacaagactgctctggaaacacttcccacagactgtgtgagaatgtgtgtatggggttgtgtttctgtatgtcaatctccatttcaaaaccaaattgaatttcttaattactgtggcttatgcaaatgaaatcttaagtttcctggaaaaaaaaaaaaaaagaaagaaagaaaaccaagtgtcagaaaacaaagactcgaccacacatgtggggactctgccttaagagcaggacaagcttaaataactccagcaggcagaattggagaatttgcctctagctgtccatacctcaatcagtgccccattggtttgacctgactttctatctttcaaacatgcattcaacattcatcaaaagtctacacaggtgccccatagatggtgtcacatgagctcaaaatctgatggagaagactggctcccttgtgaccacatccagtcttacgttttaggcaccatccagtcctagtctcccaattttgtatctctagccctgacggccttgaactcaaaaaccacatattcaagtgcacgttaagtgccttctccacctggatatctaatagacatctaaaattttatagggccaaactgaatcttaacttccagctcctcctgttgctgtccccatctcaggaaacagctacttctttccataatcattaaggccaaggagactggaatcatcctcatctcctttctcccatagcccacacccaatgcaacaacaaatcctgtccactctgtgtttggaatacagcacagagctggccacttctcatcatgtccccacttccaggagacccaagcctccttcttctctgccctgaacagcagcctccagcctcacccctttcactccattttccccacgatggcaaaggcctgtcacagcaggtcccttttctgctcagaaccctccaagggtttcctgtgcctcaggatcaaggccaaagtccctgcatggcctatgaggccctgcaggatctaccaccttctgccacctcccagcctcactttttcccttccagaactcctacccactggctctgctctagcctctaaccactgacctcctgcataccctcctttgcttgtgagaggaattcaaactagcagagcataaaaacaacacctgggatgatctagaatgaggattccaaaactgcaggtcttcctagtcaacatgactggcttggccaaagtgggctctgccacagcaagaccatcctccaaacggtggccctgtaccctttacatttcctgtgcccttagcctagaagctttccctagatacctacatgggataccacaccatacatgatattccatgattcagctctctgctcatagctctctttcccctgggaaagaccatccctgaccaccctataaaaaccagcaatcacagccataaaaaaggatgagttaatgtcctttgcagggacatggatgaagctggaaaccatcatcctcagcaaactaacacaggaacagaaaaccaaacactgcatgttctcactcataagtgggagttgaacaatgagaacacatggacaaagggaggggaacatcacacaccggggcctgtcagggggttgggggctaggggagggatattaggagaaatacgtaatgtagatgatgggttgatgagtgcagaaaaccaccacggcacatgtatacctatgtaacaaacctgcatgttctgcacaagtatcccagaacttaaagtataataataataataataataataataataataataataataataaagccagcactcctgccatcactttcttaccctgtgtgctttgtcttcataggaccagacatgttagatatttccatgcctgcctccccattagcatgtaacctccatgaaggcggtggctttgtttttctcactgctattccccagcatctaggccagtgtcaagacataataggtacccatgaaatatttgtggaatgaatgattgaagaggactctagccctttaccaatgtttcacagaaccctgctgaacctcaagggaagatgattagcccagtcttttctgggagaagctgcagaaggggtgcagggggccccagatgcccccccgcctctgctgcaggcttcccagactcacttctgcccagaggggaaagagaagagggctgaagactgtgcagtaaatgtgtgtgtgaccctgctgcaggagcttggaggccaagggctgagatgcatcttaaacaaagctttgaggttaagcatttggctgggaaccactcattagtgcatcatgtcattagaagcaattagcacctccggctccccagggcttggcttgtaagccattaaccctttggcttcctgtagagccgggaagccacgctgacctgacctggacaaggcttgtgacagaccctggctggcctccgggtcacctagagagttttgaccctggggtcttcacctttgccccagaaaagtctgccctttctgcagaggttggaagccttcctcccatctccctcctgtaagctcttccccttgggagtcagctcaggggtacaggaagccatcttactctctccatggggatctcttccatcacagggatgggggttaagagggtgagaactcccccaaattccagagtctacatccacaaccaaggccttggaaatgcaaagcaaagtccagaaaagtattgatggtttcaaatactgtgacgcaagacatattcactgcatcactatcagccttcaacacccatatctgttggttccaacttatatttctgtgtgtacaaataatacaccctgtgcatgaaaaatcagtttcaaaagaaagagctgaatttgtctagaaccctcttgtgttttctctctagtcttcccaaatgtcctactcatcaatcctcccaaccggaaacctctaagcaagagacatgaattggaaaaccagaggggttgagggaggacatcatgaaaacagtggtctttgttgatgaccataaacttttcactcgagaaagatcttcctcctagtgagcttggctcatagcccagctgtttgctacagggaaggtgggcagcatggtacctcgtacgcagattctctggctggggtggaccatcaaacaccgacaggacatcaaagtcctcttccagggcaaaggactggaacacaagctggattctgtgctgctcttccgcggtgatggtccacgtgcagttggcgtaattggggtagccatatgggaaccctgggctctcaactgtcccattgggaccgtgcagttggaacgtgcagttctggcctgggaaagagaaatggagcagttcagaatagccagaataactcctagaagcttctagagagtcaggagcaatgtgttagcaaatcatgaacccacttttccaagtgcttcccatgagccagccctgtacttggcaccgagggaggtacaaagggtgactaacgttgattgtcggcttgctgtgcgctgtgtactgaccaggtgatacattgtgtatcatttaatcaaggcttacaacaactctatgcagtagaaaattaaggctttgagaatctgaactacacagccaccaataccaggctgaactcagacttcccctctacaacatggaatgtcagaaccacaatttcaaaccttctccattgtctgcaacctcctggctctcagctaattcctctccctcactctccatagaaaataaaagccattcctaaggattcccttgtcttcccaattccaaacccttctagcctatcccatgctgtcttcattcctgctacagaggagctacctcttcctccatctaaatggactcttgccaagagtctcgactcttccctactcttcaagaacagtatacgttcctgtttctttctaacgtgtgttcagtcatttcctctccactagtatcttctcattttaaatgtgctcaagactctatcgttaagaaaaaaattccctaccccactcctcgtctccctccagccttgtctctctctccttcacagctaaatttatagaaaacacaatctgtctatactttctgtctccatttccttacttcccactcactctccaaccctgtcaattctgccttctggtcccattgatccacccaaacagatctactacccatgggctcagtggctatttttccgttttcttgttaatttactgctcagtgcctctgactgctcttgctcaccctcctttcagaaacactcctccgggccagagcatctcagacctcactgtgcacacgcatcacctggggaatctgtctcaaatggagattcagatcgacaccggggtggagctggagggactgccttcccaccatgctccctggtgatgtgatgatgccctctgtgggaccacactttgagcagcaatgccctgagcttcctcccacaataccatactcctttcctgctcctgctctttctctgcctcctttcagtctccgtgccaaggcctctgctcctctctccgatttgggggacttcccacttgtgcattggttactcacaacgtcatgatccaggccagccatccctctgtgggccaggcccatcacccctttgggatgctctcgatgtccccccacccactctctcctcttctgttgcctaccccccaactcagtgaatggaatcatgcctccatctctttatctaagtaaggctcacctagaagcttcctcttcttcacaaccccatggctaatctaccactctatctctatctccgtctgtccccaccctacaccaagctcattcctaaactgccgtattaactcctaactggtcagccacatttgctctggtccttgccaatctgttcttcacactgcacgcagaaggtggtgaggtcatgccaacctcccaaatgccccaaacattcaatggctcctccttgctcttcaataaggaaaattaaagtatacaaggctttccacatggcctggcccttagtgacctcccagcttcatatccaccagctttccagccaaatcctgcctgtttctgtcctttgtatctgccacactcttgcactgcagagccacaggacctttgcgcggttctctctgcctacaacactcttagcatacccatctttcagatctcagcctagtgtccttccttggtcaggtcaagcccactactacacagtgtcatgacaccgtaacttctccttggtggtacttattataaaagtaaatctccatgcttccaagtgattgtttcacaagtatctgtcttctcaccaggctgaatgcttcatgagagcagacaccacatgtgagtttgcccatctttgaatccatgtcccaagctcagtattaggtacatggtaaattctcaataatttaatattttgtttgtatttacttagtgtttggctagacactctcctaaaaactttacctatattgatttgtctaatcctcacaacagccctatacggtagatactattactatcatctccattttacagacgaagaactaaggcagaaagaaattaagtaatggggcccaagtcactgttacacaaaggtgggattcaaacataagtattccacttcgaatccattttcttcaccatgatgctgataaattgactcgacactaatttttttaaagcccattttagggattaactgacaaaggacagttaatctctaaaggactttaatattaagaaatctcttaacacgaagtatcccattaaatgagaaaaaaaaatgttaaggtcttctgaataaatcctaaacaggcatttcataaaattaggcatgtaaccctgattaaaataagcattcaaaactaggaaaaagaatatttccttactatgataaagcttcaattttagaacaatactctacattgtacttaaggtgaaacacctgattaagattgggaacaagacagaggtgccaccatcacctctgggatttcacggcttattggaagagttaacccatgtgacacaagaaaaagaaatgagaaaagaggaagcaaaattatggtttgtagatgatacattaatatacctagaaaacccaggagaattcattataaagctattatagataatatgaaattttaataaactagccaaatgcaaaataatatacaaaaatcagtaacattcctatatgtcaatgacagataaaaatataaagaaaaaagatcttgtttatggtaactacaaaatgcatatagtacatataaacttaacaagaagtgtgcaggcacgatatgaaaatgacttttacagagggataaaaaatttgaataactggagagacatagcataatcttgagtggatacagaaaggttaatttatgatattaacctcttgacaagttacagaaaagttaatttataagtttaatgcaattcggatgaaaagcccaatgacccgttttaagtttggtaaaatgatacctaagtttaactggaaaaatagattgtcggggggaggagccaagatggccgaataggaacagctcccgtccacagctcccagcgtgagcgaggcagaagaggggtgatttctgcatttccatctgaggtaccaggttcatctcactagggagagccagacagtgggcgcaggtcagtgggtgcgcgcaccgtgcacgagccgaagcagggcgaggcattgcctcactcgggacgtgcaagggggcagggagttccctttcctaatcaaagaaaggggtgacggacggcacctggagaatcgggtcactcccacccgaatactgcgcttttccgacgggcttaaaaaacggcgcaccacgagattatatcccgcacctggctcggagggtcctaccccacggagtctcgctgattgctagcacagcagtctgagatcaaactgcaaggcagcagcgaggctgggggaggggcgcccaccattgcccaggcttgcttaggtaaacaaagcagccggaaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagtacgcagctggagatctgagaactggcagactgcctcctcaagtgggtccctgacccctgacccccgagcagcctaactgggaggcaccccccagcaggggcacactgacacctcacactgcagggtactccaacagacctgcagctgaggatcctgtctgttagaaggaaaactaacaaacagaaaggacattcacaacaaaaacccatctgtacatcgccatcatcaaagaccaaaagtagataaaaccacaaagatggggaaaaaacagaacagaaaaactggaaactctaaaaagcagagcgcctctcctcctccaaaggaacgcagctcctcaccagcaacggaacaaagctggacggagaatgactttgacgagctgagagaagaaggcttcagacgatcaaattactctgagctacaggaggacattcaaaccaaaggcaaaggagttgaaaactttgaaaaaaatttagaagaatgtataactagaataaccaatacagagaagtgcttaaaggagctgatggagctgaaaaccaaggctcgagaactacatgaagaatgcagaagcctcaggagccgatgcgatcaactggaagaaagggtatcagcaatggaagatgaaatgaatgaaatgaagtgagaagggaagtttagagaaaaaagaataaaaagaaatgagcaaagccttcaagaaatatgggactatgtgaaaagaccaaatctacgtccgattggtgtatctgaaagtgatggggagaatggaaccaagttggaaaacactctgcaggatattatcccggagaatttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcaggttaccctcaaagggaagtccatcagactaacagcagatctctcggcagaaaccctacaagccagaagagagtgggggccaatattcaacattcttaaaggaaagaattttcaacccagaatttcatatccagccaaactaagcttcataagtgaaggagaaataaaatactttacagacaagcaaatgctgagagattttgtcaccaccaggcctgccctaaaagagctcctgaaggaagtgctaaacatggaaaggaacaaccggtagcagccactgcaaaatcatgccaaaatgtaacgaccatcgagactaggaagaaactgcatcaactaacgagcaaaataaccagctaacatcatcatgacaggatcaaattcacacataacactattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagaaaatggaaaacaaaaaaaggcaggggttgcaatcctagtctctgataaaacagactttaaaccaacaaagatcaaaagagacaaagaaggccattacatgatggtaaagggatcaattcaacaagaagagctaactatcctaaacatatatgcacccaatacaggagcacccagattcataaagcaagtcctgagtggcctacaaggagacttagactcccacacattaataatgggagactttaacaccccactgtcaacattagacagatcaacgagacagaaagtcaacaaggatacccaggaattgaactcagctctgcagcaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaagcaagaaataactgaaatcagagcagaactgaaggaaatagagacacaaaaaacccttcaaaaaattaatgaatccaggagctggttttttgaaaggatcaacaaaatagatagaccgctagcaagactaataaagaaaaaaagagagaagagtcaaatagacgcaataaaaaatgataaaggggatatcaccactgatcccacagaaatgcaaactaccatcagagaatactacaaacacctctacgcaaataaactagaaaatctagaagaaatggataaattcctggacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagaaggaatcctccctaactcattttatgaggccagcatcattctgataccaaagctgggcagagacacaaccaaaaaagagacttttagaccaatatccttgatgaacattgatgcaaaaatcctcaataaaatactggcaaaccgaatccagcagcacatcaaaaagattatccaccatgatcaagtgggcttcatccctgggatgcaaggctggttcaatatacgcaaatcaataaatgtaatccagcatataaacagagccaaagacaaaaaccacatgactatctcaatagatgcagaaaaggcctttgacaaaattcaacaacccttcatgctaaaaactttcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagcgttggaagctctggccagggcaattaggcaggagaaggaaataaagggtattcaattaggaaaagaggaagtcaaattgtccctctttgcagacgacatgattgtatatctagaaaaccccattgtctcagcccaaaatctccttaagctgataagcaacttcagcaaagtctcaggatacaaaatcaatgtgcaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatgaaaccaaaaaagagcccgcatcgccaagtcaatcctaagccaaaagaacaaagctggaggcatcacactacctgacttcaaactataccacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaagtggatcccttctttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaattgacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacgcatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaacatcacattctggggactgttgtggggtggggggaggggggagggatagcattgggagatatacctaatgctagatgacgagttagtgggtgcagcacaccagcatggcacatgtatacgtatgtaactaacctgcacaatgtgcacatgtaccctaaaacttaaagtataataataaaaaaataaataaataaataaataaataaaaagaaaaaaaaagaaaaatagattgtcacaatgcattgtttagagaagatagtaaatttagcagtctcatttcacaagatactaaacagcatcataaatgacacttatgaaaatagtgtgggggtggtccaggagtaaacaggtaggacatgaaatggtattgcatgaatatctttaatgcacataaaaatggaaatatgtatcaggcaatattaaaaaaaattgagaaaagaaaaagacttttgctggatcaactaataaactgtttgggaaaagaattaagttatctcctcgaatcgcaccatatacaaaaataacttccagatggagcaaagagttacatggtaaaaaaataaagtcataaaataatgagaagaaaacctaggtaattatctgaccgtgattttttagcataatagctgtggaggatactacaagattgatattaaaagtatgcatatgtcaacaacagaatatcagaaagcatacaaaaatgttaggagaaaagtaatatggtgaatatagaaagaactattactaatacttagggggaaaagtactattagtaataattggacaggatctgaacaaattagttcacaaaagaagacataaatggcccagaagccagaaaaatagccaaccacagtgataatgaaataaagcctctaactccacaactttcagagaagccctgagtacacttccttgaactttccctcactggtacaggtaccagatttactttgctcctgtccctaaaacctgcctggtaatgtcactgcatcatgccattaattccttccttcattcattcattcctctaggatagaccctgtgataagccatggggacctggatcatagactagaaacaagtaaatcaaaatatgtcattagacaataccatgctagaggggtacacagagtggttctgaagtatagatgccacaggggccacatcttaagggcctccccgattcgtgttgtggacaaccaatgaaatatcaacattcaccaccatctccagcatcccagacctctgccttggctcagacctgccaaggacaggagattctgattaagaatctgggtgtgaatggcatcttctgctatagagaaagaagtgaaggagttcagaacagagcctctgggaacatctcccatgtaaggggacagaaaaggtgacagagcagggaacaggtagaatagtcggagaggatccagagggcagttccatgtgggagaggttgactcaatgtggtgaacagcacagaaagactaagatgagggtcttgaatgaggtcactctgtctggtgtctaaatagtccctctggaagcaatgctgagagctggagccttgacctggtccctgctgcatccctagtgcctagaattcaataagtatttgctgaatggatagatcaatttcagcaaaggcaggtgggaggatggcaaggtggaaagagggcagattgtaataggcaagattggctgatgagaaggtggaaggccattgtattctaaacaataacttctacattgtagaaactgaaaaatacaggcaagatttaaaaagagaaaactgattataatctcttccttccagaggcaactgctgttaatattttcatttttctgagatttttttccatgcatatttcacactggtgagataacaccatatgtataattttgtgtgctactttttctgtaagttattcttcaatcttcaatttaaaaaggcaatgtggacttgtaatatgcatagatatgcacatacgcaatgcaagtataaaaaaatatatatgcagtctccctcctccccacccaatccaaaattaccgaagttaacagccaggtatgtgtccctccctcaccttcttctctctcatgcaaaccacacagacacattctgggagaattttgattatttcatttaaaaaataaaactgtagtttagctcatttttctgcaacttgctttctcacttaacaatacaccggggacacgttccaggtcagtagatacagatctaacttattttttatatgaatgtgtaatattccatgccatggatgtatctcaatttattcaaccactcccctgttgatggccattcaggtcatttctcggttttcttttgtaacaattcagtaaacattataacgtgagcattccctaagatactgaatctgttcataaacagcattttaaatggatgcacaacgtttcagtgtatggttatactagaatttagttagccattctcctattgtcaaacatttaaattgcttctggattttttgttccattgtaaataagacctggacccttagttagatctggtgataggatgctggtcaatgcagtggaaaatgcctttccacggccagagtcccagaataaatgttcccctatacagtaactgcctccagctttggtttcaggtggggtcgggtaaggtactgtccacattaggctggctgacctctctcagggatggctagaaagggttagaagcctgactcatttggaaacctccctgaaaccaatgtatgttagtaagttgaagaagttataacccagagcagccactccagattgaaatgtgaatggaatgggagctcatgccagaatggctttgtcctttcatgcccatgaaacgttgaatttctttcaagaaaaagtctacccgttcttcacttctagtgactgatgttctgccctgtagatgggaatgctgctactgacctccattttgacggcaccttgcatttctctctagccaggatggtctgccttctttcacccatgctttgagtttctggtcaatgcagctacccccatcaggctccagaacaatctcagagaactagactcctcaagtcattgctcattcatttgttttggatgatttggatgatttccccaggacagacttccaaatagcagatgactgggtcaaatggtatgaacatttctgaggctttggctctgggttaacaatatcctttctaggaaatgtgcacccattaaactctcaatagttatgtctaggaatacctatctcacagcacctttgccaaccttgtgtattgtcttatttggaaactttttgcctgcttattaggtgcaaaaaatgtgatctcattttacttagtgatgttttatgactcagattcaacatctttttcactttttctaataattttaatttcttctttttggaactagctgatcaaatcctcagctcatttttcattgtggtatttttttccctcatttcttacctacttatctattttatatatgtgtaatatattaatcctttatgcatcgcatgtgctatatatgtgttttgtagttgtttggccttttaattttatcatgtttgacatactgaagtttctaaatgttatatacttaaatcttctattaggtcttactatttttcttgttaatttgtactaactctttatagagtcagaattttaatcttttgtcatatttgttgcaaatattgttttctacctggttgtgtgctttttgttttgtttagatttcccatgtagattaaaatgttcacttttttttttttgagacagagtcttgctctgtcacccagactggagtgcagtggccccatctcagctcactgcaagctccgcttcccaggttaatgccattctcctgcctcagcctcccgattagctgggactacaggtgcccgccaccacgcccggctaattttttttacttttagtagagacggggtttcactgtgttagccaagatggtctcgatttcctgacctcatgatccacccgcctcggcctcccaaagtgctgggattacaggcgtgagccaccgcacctggccaaaatgttcactttctataggcagtcacatttatctcttttttcttggtaatatttttcccttgttcacactgagaaagacttctctcaactaaagattggttggcttctcatctcactcaacataaaagccaaagtcctcaccatagtcctcaaagctttaaatgaatgggtacccagatgcctgtccacctcttctcctatctcttgtcccctcatccctgtgatccaaccatatccctgtgatccagccatatccctgtaatccggccatatccctgtgatccaaccatatccctgtaatccggccatatccctgtaatccaaccatatccctgtaatccggccatatccctgtaatccggccatgctggacctttgcatttgccaagacttcagcccagaaaatgtttccccagtagccatgggacccttacttatttccggtgtctagtcaaatataacctccttggagactaccctaagtacaattcagacctgcttctcaagccaggtgttcctggtgcctgctttatttgttgatagcacttagcacctctgccatatattttcctcttgttaattttctgatgcaccctccccagtaaaatacaatctccatgagagtggggcaccatttttttctctgctctatctctagctcgcagacctgaacctggtacataatagatgctcacagaatagttgttggttgaatgaatgaataaatgaatattaattgcccacctagcattctgtgcttggattgttccttcactcggctaactccaggcattttcaaactcattaccttctccagaaagccttctgggaaccctcaagacaccatcaagtattcgtccactccttgtttatcattcatgatgaatgtcattgccttcatcaatggtgatataatgatatgtttatgtggctgtctctaccagcaaactccttgagctttttttttttttttttttttctttctgagccagattctcgctctgtcaaccaggctggagtgcagtggtgcgatctcggctcactgctatctccgcctcccgggttcacgccattctcctgcctcagcctcctgagtagctgggactaccggcacccgccaccacgcccagctaatttttcacgtttttagtagagacggggtttcaccgtgttagccaggatggtcttgatctgaccttgcgattcgcccacctcggcctcccaaagtgctgggattacaggtgtgagccactgcgtccgaccctccttgagcttttcttcaattttatttccatcacctagcccagtacttgcccatagtagacactcagtacacatttttaaatgaatgagtgagtgaaatgaattaatcttttgtattaggttggtgcaaaggtaattccggttattgccgttaacaatgatggcaaacacacacacacacaattacttttgcactaatctaatattcagaaaatactcaccaacttcatttatctgtgtatttatggtttattttggaagtggcttagtggaaaggttaaaagcataggttttggaaacaaaagctttgggttcaaatttcagatttgccacttaatattgtgtgtgggcaacttatttaaactctttaagccttagttttgacatctttaaaattaacacccacttctaggatggttgtacagattaatgtgatatctgctgagttgctaaatgttcagtacagaacctggcacagcaaacaccacctaatctttcagtaaagattagatgcttttctttaagtcccagtcacatcttgttaaggttattcacagacattttatgcactttttgccgcactagtgaatgtcatttttctcattatttttttctaactggtttttatgatatacagaaaacctattgatttttatacattcatctcacatccagccaggtttctgaacacttattaattctaaaaatttctcagttggttcccttgggtgttttaggtacacaatcatgttgtctacaaataatgataattttaaggagataactctcttgagaagtttggcaggaaaattcaattcaattctgcaaatatttattgactgataaggtcaattttggacaaatttagttggagatgccagtgggacatccagacggagatggccagaaggcagttagggctgtagactggtgtttgggagtgcaatctggactggggatatggatttgttgaagccacgcaattaatgaaactgccctaagaggaaacacagcggggagctgcagatgctggataaatcatcacgcccgctgaaggtgtctcacctgccacacggagcaccagctggacacctcaagtctacaatcagcctctggcccatcactatgcatgccttctggcaggggcaccttgtccgctgatgagagaggcaggggtcaaacagtatctttggctctctacaatgatcctttaggaaaggaccaagaactaggtcattagggatgctggcactgagcctcattttagcccctctcccctgcacagcatgtgcctcagtcacaccactaatttgtcacctgcagtgcttggccctttgcctcatacgcccttccactgcaaccttctcaacctagcaaatctaactcacggtcccaggctcagttcatctcctctaaggagcctcctctagtctgcaggcagttactcttcgctctccgctacccccatctccctatttcgtgcattaagtgctgggtgacacaattatcacagatgtttttaatgaagatgtgcactatttttttttactacagatcttaacaatcggagagatttctgtgaatgtgcagtagtctaatccagggtttctcaacctcaacactatcaacattttgggtgggataattcttcactgtgggaggctgtcctgtacatataggatgtttagcagcgtccctgacctctacccactgaatgccagtagcacctcccaatgtgacaaccaaaatttctccagatattgccaaatgtcccctagggggaaaatcacctctagttgagaacgactggtctaattcttagccatattggagttcctaatgaaagtcagaaatactttttctagaatcacatacataggaagctaaccttctgccgttttcattcatttcaggggattagcaggccaaaaaagcctatccctggacctccatgacctgaagtcctccatctttgtcgtgccatgccctccttggagcctcgtgacaccacctcaaatggtgtcttaaaatatgtaaaacaaaatacatagaattgcaaaggaaatcagctagattgaaatatagtttttaaaatatactgaaaatcgatcatacactaataagtgctcctttattaatgcattattaataagatctagcagtgggcctgatacatattgtagtttgaagcataaatgctacttcaagataattgtaacaactgtaatgttctatggaaatatctgtgatcttaccagtgacaaattcacaggtactgctaataccacttccgtgtttgttgcctatcttcatgattggtagaaatgctgtttcagtaggagattagtgaaaataatgcaattgtcctcatccaagttagggaccccatggattctatcaagaaccccagaggtccaagacaaattcagtctttcagtcagcaaatctggggaatggatggcttagttccagggtttataggtgggggtgttaatgggcagtagggagttgggggagatgggaggggcagattgcatataatatggtccatgccctcaaggagttcacagtggattgtaggagacagacatggcccatcttactagccatctccacgtgacaagtggttcagggaaaccatgctgttcaatcttaggggaacagaaaggagcacagacaaacctagaaggactggtgctttcatgcaagtctgagaaggggccaacatttctgtggttcactaacattatctctctaacatttgcaatgacccttttgaaatggctgttacagccccaccctcatcatattacaggtaaagaaactaaggctcttcaaggtttaaaacatgttcaaggtcaaacaagtagcaatggaaaagctgagattcaaacccagatctgtacaaaagcaaaacccaggctctcaaccctaccacccttccctctgccaggctgcaaatatttcacacacatcatctcaggacatactctcaaagctatagttctggttccactctgcacccagcaccaggggtcagagcctgggatttattgaaaagagcttagcacagttgctgtgcctcagggacctggatacaaaacgggtctcctttttcctctcaagctggggatgcatgcaacaaaggcacaaaacaatgcatggcaggtggggtgaagcagcaagcctgtccctgtaccatattcaattgcttcgtgggaataatcccatgccactcagcttcctaattctaactccaggctttctgattctcctggacatgtttaacacagaagccaccattgcggaccaaacatgattttccctgcatggtgatacagatgcagttcattttccatcatcctaagccaacactagtcaagggttgtttattattttgacagggaatcctggactagcagaagcatctctgctttactgattcttattatgccacagccctggatcagcagcaagagaaagggccaggtatctctggggccaggggcctctgccaggctgattctactcctgtctgggtctttcagagtgaaaacaaggaactaccattgagttctccccagctgagaagatgcctgagctatggctttggtccacgggacaatggctaagcacaggaacagactcatgaaagttgagggcttagcaaatgcttgattcattcatttacttattttgaaaatagtattaagcacccactgtgtcccagtgagtgcttcctgccctcatggagcttacggtataataataataatatattattaaacattttttctgtgccaagtactgtcctacgcactgtacatataataattcattccatcctcacaaccatatgagataggtactattactctccccatttcataggtaaggaaactgaggtctaggaaggttaagtaatctgcccaaggtcagacagctgataaaaatggaaataggaatcaaccccaggcaatctggtgccacatcctgtcttcttaaccactactctatcatagatgatggatggataggtgggtgggtggatggatgaaggatggccaatgtagtaagctaaactcctttctacagcactctcatacagcaaagaacttcaccttaggtagccctttcctcaagtgtcagtcatgtcagttagaactcctaggcttctgtcccattgcctgacatttggggaatgagtccactatggtgaggttcagcacagtggcagaaaggggaccacatggggacgcctgagcacattgaacttcccagaagaaaaagaatcataataactcgggaaataggagtgaattgtcaaaatatgtgaaaccaagcctatgctgctgtttctctcaccatgagaatctcatgagggcaggaccacgcctgactcactgttaaatcccaacacaaggcttggcatttcatagacactccattaatatttgtcaagtaaatggattaatttgtctgcttgtcaacggtgtctttcttttttcttttcatttgtttctttatccattaaaaacacatggctcctgttttatctggtggaactggcctcatccctaaagaaaataggcaacttcaagccctgtgcccttatgtgagacatatttgaaaattaattttaaaaatgagagagagaaaaagaaaacaaaaccctaatgagagagagagaaaaaaaaacccaaaaccctaacatagtgccatggaatcagaaagcctgggttcttaactctgccttgccacttgctagcaaggggtatggtcaagtcccttagtcacttatggcccctgcccctctatctatggaatgaggttctcaagaccacattcacagagatgctctgatgcagctagcccaagtgagttgttggtgcctgactggagcaagagtagccctgtccatggtccggaaccgtaaatgtcctcaggggaggctgtttcttctgctcctaagccaatggggatgcctgtccaacctctcccataatttctgcaccagaagaaaaaggaactacaatgataagaaagtaacaaagagaattggtgagataaaggaatgaagggatagaaagagggaaagaggctgaagagggaaaggggtgaaggtagaagagagagcactgcagctccattcagaatcctgagtgcccgagactctgtcttcctgccttgggccagacggaaccacagtagaggtgatttgacacaggagtcctgggatagggagggcaatccttgcaaggtgtactcccgagatgttcctggcacttattcttcagtagccaatgacacagaggaggacaggtgggaggctaactctctagagatgaggggtggtaagacttgaaatcagaaagcatgagggccagcatcaaggagggcatgacatgtggtcaccagctgttggatgcatcctcttgtttctccatagcagcccaaccccctcattcctctgacagcttcagactggacatctactgggaatccagaaggttcactcatgaagacagtggcagcagatccagggcaagatcaatccagatcattctttaaattaaggcattcaaaggtcatctgcaatttcactttgctttcccaatcttcagcagacgtgttgctcattttacatataaaggaaagggttttgtgttttgatgcccccaactacacgtttgaattgtatgagcactgatggtgatttgaaagttgttcctatcaaaagggagagctcaaatcagctccctctgctcaagcaaattagtgatggggtcagtatggccctggctcagctcagaccagtctagatgccagcaggggctcatcattcaatggacatttggcatcttcatcatgaaacttttgccaatccagaatggtattgcctacgttgtcccccagagtttttacagtttttggttttacatttaagtcttttagagcttctgcacagcaaaagaaactatcaacagagtaaacagacaacctaaagaaggggagaaaatatctgcaaactatgcatctgacaaaggtctaatattcagcatctgtaaggaacttaaacaaatttacaagaaaaaaataaacaactccattaaaaagtgggcaaaggacatgaacagacactttccaaaagaagacatatatgagccaggcacggtggctcatgcctgtaatctcagcactttgggaggccaaggcgggcggatcacgaggtcaggagttcaagaccagtctggccaacatagtgaaaccccgtctctactaaaaatacacaaaaaattagccgggcgtggtggtgtgcgcctgtaatcccagctactcgggaggctgaggcaggagaatcgggtgaacccaggaggcggaggttgcagtgaaccgagatggcgccactgcactccagcctgggtgacagaacgagactctgtctcaaaaaaaaaaaaaaaaaaaaagacatatatgagactaacaagcatataaaaaaagctcaatatcattgatcattagagaaatgcaaatcaaaatcacaatgagataccatcttacagcacccagaatggctactattaaaaagtaaaaaaataacagatgctggcaaggtggtggagaaaagagaatgcttatacactgttggtgagagtgtaaattagttcaaccattgtagaaagcagtttggtgattcctcaaaaacctagaaacagaactatcattcaacccagcaatcccattactgggtatatacacaaaggaacataaatcattctaccataaagacacacgtttttatgttcattgaagcactattcacaagagcaaaaacatggaatcaacctaaatgtccatcgatagtaggctggataaagaaaatatggtacatatacaccatggaatgctatccagccataaaaaaaaaaccaagatcatgtctcttgcaggaacatgaatgaagcatatatattaagatctccatcttaagctagaagtcattatccttagcaaaccaacacaggaatagaaaaccaaataccacatattcttacttataagtgggagctaagtgataagaacacatggacacaaagaggcaaacacatggacacaaagaggcgagcaacatacacgagggactacctgagggtggagaacgggaggagggagaggatccaaaaaataactattaggtactaggcttaatatctaggtgacaaaataatctgtacaacaaacccccatgacatgggttgactatataacaaacttgcacatgtacccctgaatctaaaataaaagttaaaaaataaaataaaatgaaataaaatattaactaaccccctacttccatcgctggcacctccaatctcccttacctgctctatgttttcttatttcaatagcatgtatcactctgtagcaccctatgtaatttacttatatattgtacttactgtttattgtttatttcctcctgctagaatatttacttcacaagagaaaggcctttgttttactcactgatgcgtcccaagtgcctagaacagtaactggcacatagtcagcactcagttaatattggttgaatgaatgaacaaactacaatccagtgcttttacaaaagtacaattcatatggacccaactccctaaaggcctaggaaaccaaaccagttggtgtggctctgtctggtagcacacagacccagaaacccagcccacaatgaaaatctgggaaggaaggatcctgaatgccacttgcccatgacttccataaccatctccccaccagactgagttccttggggacacagagcatggtctgccttttttaccactatatcattgaggatccagcacagggctgccacaggatgcatgtgtcagtaagcaggaagttgaaggaatttcagccatcatttatcaggcactgactgtgtgtgccccacacaatcatgactttggtccttgcgttatttctgttaaaccttccaatatcccaaagaagcaggtattattcttcatcccatttaacaaatggggatcagggtaagtagcttgcccaagctcacacatacaataacatctggcaaagctggggttcaaacacaggattctctgactcctgagactgagatcttaaaatataggctctaccacctcactggtatgaaacaggaagggagggagagagaaaaagatttgggctggtcatatgccagacacagcatgaaggcctaaaagagctgaccagagctaagaagcttttctcaactagacacgactccattacagccctgtctctgtctccctgcccccagaggaaggacagaggtggcagtcttggctgaaaggaaccttatttcaataaattctttcaaattctctctctctctctctctctctctctctctctctctttctctctctttctctctcgcagtttgaatgaactgagggaaaaatatatctgagtgggtggacagataatctaaaaattgtgtcagggagtagtagagaaatgtacttcctcttacagtctctataaaaggaaaccctaacaagcttattgttgccccttgcccatacacatgcaaaccaaggtgaaaaacatgatcaggctgggcatgtggagacactgggttcagaacccagcccagtgacctcagacttctgtttagaagacattgccatggccatttccccagatgcccagttctgcccttaatggcctttgctcaccctgggcttccccagtcttgtcagctgcagccccagcctatataactacctgctgtccaaccgcctccacactgcagcagacagctctatctataggcactccagccatgaggtaactcaaagggtttcccagtggactgctctgcagagttatgtgaatgaatgtcctggagacccttcaaagcctccagaaatacttccaatactagccttcttctcctgtgggcatactatgctttgtcaccatgccagagactggggcatgaatttctgggtcatatgggcagccttgagaaaaatcaaaagtatatgttgaatgaatgaatgaatgtgccttccaataagataatctataaagagtaaaatctatataggcctctagaatctagttagtccaatgctagagatttctggcaagaaattcacaggcttgggagtagcatggggatatagaaagaaaaggattcaagccaattcaatggatttttactagggcctcctaaaagacagtctgacccttccctgacaatgctcatggctgaggggcagctggtgtgtgggtgtgtaatataggaaagcaaggaatttatagaaaggagaaaaagagatctacggccataccaccctgaacgtgcctgatcttgtctgatctcggaagctaagcaggttcaggccttgttagtacttggacgggagaaaggagaaaaagaaggacatggatgggaaggtaggacccagcttcaaccccaccattgtgagctaagctctactcctggctgagtcactcatggctcagacttcttaacttgggtttggaaatggttgtgtctctgagcttcctcataccctccttgtgacacttcccaactgaattcttaggatcaagaggtatttatctccccatgccctccaagagaaagtgtgggtcttaaaacgcatgagttgagagagccagaggtgtcacacatgggtggcagagcagcgacccaggacctgtgactcctgacagttgtcacagatgcaacatcctctcaaaacatgtctaaccttgaaatggctaggagcacatgttcatccatagcatgaataatatgcaagacgcacatgggtgaacaaagcaagaccatcacatgccccatggtcacttgttagctgggagagactttattatggcccaacaagacctttataattgtaaatccctggcgccccctcatggcccttacagtcctgtggcttctgctgaggggcagtgggggaaaggtgcctggaggaggtgccaggggcttgggagtgacatcagctagatggcagaataggaagccccagacattctgccccacagaaacactgacttaacaacaatacacagtccaaaaaagcctttatgagaactctagaaaccagttaagaagttacagtaccccaggcaagctcaaagtgaaaagccaccatattgaaatgcataagaaaaattgtttcatgtcaaccataaaaacccttctcccaactgtcacagttcagtgagactgaaggaaaaagttcaacttgcagcttcccccttggaaaggaaagagaagagcatagcatacattcagtgttcccacttttcagtgggctgcagagggaccggtttctgtctcacctgacagaaaccagagtgctgatggggaaccagcatactttcaatgcctgggggccatggagaacaaaagacagttcactggctttttgcaacaccagagaacctgagtaccataatcagacaccagagggagcaagaaattacaaacccttgaaggaaaaacaaacaagacccagtaaacctctttaattaagaaagtacacatgcaagctcagagaatatatatcccaaggaaagcccccagaacctctagctgctgaagactttcccttgtgtaaaactactctgtaaagactgggagaactcctttgttgttgttgttgttgttgttgtttttcaaatgcagaaatcactaaaaaaataacaaagcacacttaaaaaaaaaaaacgaaaaacaaggcaacatggctcaactaaaggaagaaaataggctgagcacagtggttcatacctgtcatcccagtgctttgggaggccgaagcagaaggataatttgaggccaggtgttccagaccaacctgggcaagatagcaagacccccatctctaaaaacaattttttttaattagctgggcatagtggtacacctatagtcctagctactcaggaggctgaagcaggaggatcacttaggcccagaagttgaggttacaatgagctattatcacaccactccattccagcctgggaaacaggatgagaccctgtctcaaaaaaaaaggaagggtggtgtacataataaatcttcagaaaccaattctaaagaaatggagatctattaattatttgacaaagaattcaaaatcattgtctttaagaagctcaatgtgctacaagaggacacaaatagacaaactaaataaaatcaggaaaatgatgcatgaacaaaatgacaatatcaacaaaaagttagaaactataatacaagatcaaacagaaattctagagctgaagactataataactgaatttaaaattttactggaggggttcaataacagacttaagcagaaaaaagaatcagtgaactcaaaaacaggtcatttgaaattattaagtcagaggaacaaatagaaaaaagaatgaacaaaagtgaataaagcctaaggaacttagaggaccccataaaatagaccaatatgtgtgttatgaaagtcttagaaggagaaaagagaaaaaaaggaacagaaagcttatttgaaaaaaataacggctgaaaacttcctaaatctaaagaagaaaatcaaaatccaaagtaaagaagcttaaaagactccaactacaatgaccccaaagaagtcaatattgagacaagaaaaagttaaagacaaggaaggaaagaatcttgaaagcagcaaggaaacatgactcatcacctacaaaagagttctcataagattatcagcagatttctcagcataaacattacaagcccagaggccaaagaggtgatatattcaaagtactgaaaggaaaaagaaaccatgccaaccaagaatcctttatctagcaagattgtccttcaaaatgaaggagaaataaagaccttcccaggtaaacaaggtgagggagttcatcgccattagatctgccttatgaaaattataattaaaggacacaccagacagcaacatgaaagcatacaaaaatatataactctctagtaaaaataaatatatagacaaatagaatcttgtaatactataatagtgatgcctaaatcattttaattctagtataaaacttaaaagatgaaagtataaaaatataagtataatgaatacaaaattgtaaaaggtgaaattcgtgatattgctaatacaaagtgtgtagggagaaagaaggtgtaatagcgtgaagtttttatatgcaactgaggcttattatcagtctaagacatattattataattataaaatattttatgtaatccccattgtagccacaaagcaaataactatagaagatgcaccaaagaatataagaaatcaaagaatgtcactacaaaaacaatcaacaaaacacaaaggaatgtagcaagagaggaaaaaaggaacaaagtaactataaggcacacagaaaacaataagaaaatggtaatagtaagtcctctatcagtaattactttcgatgtaaatggattaaactcagcaatcaaaagacataaagtagttaaactgacttataaaaacaagatctaactatatgctgtctacaagagactcgttttagacataaggacatacataaatgaaaagtaaaagaacggacaaagatattccatgcaataggctaaaagtgatagaatagaaaaagatttttcatgcaaatggtaaccaaagacagcaaggtgattatataattatattagaaaaaatatacattaaatcaaaaactgtcacaagagacaaagaagacattgtataatgaaaaaagggtcaattcaacaaggaagatataacaattataaacatatatgtacctaacagaagagcacccagatatatgaagcaaacattgacagaattaaagagaaaaatagacagtaacatgataaggaagagagatttccataccccactttcaataatggataattaatcaaacagaaaatcagtaaggaaacagaaaacctgaacaagactatagaccaattggaccaaatagacatatctagaataccctacccaacaacagaatatacattcttctcaagtgcgtatgaaacattcttcaagacagatcacatgctaggccataaaataagtcttaacaaattcaagaagattaaaatcataccagttacattttccaactataaaggaatagaactaaaaagcagcagcaaaaggaaaactggaaattcataaatatatgaaaattaaacaccatactcttgaagaaccaatgggtcaaagaaaaaatcacaggggaattagaaaatatcttgagacgaatgaaaataaagataaagcatgccaaaaacttacaggatgcagcaagtgttactaagacagaagtttacagcagcacattgcacatgcattaaaaaaaagaatgatctcaaatcaataacctaactttacatgtaaaagaactagagaaagaacaaactaaacctagagttatcaaaaggaacaaaatcataaagattagagcaaaaacaaaggaaataaataatttttaaaatggggaaaaataaacaaaattaagagttgatttttttcttagttagactagcttagaaaaatagagaagctcaaataaaaatcagaaatgaaagacaagacctacaattgatgacacataagtaaaaaggattataaaagactacaatgaacaattgtatgccaacaaattggataacctagaagaaattgatacatttctagaaacatataacctaccaagactgaatcatgaagaaataaaaactctaaacagaattagagctagtgaggagattgaatcagtaataaaaaacctatctacaaagaaaagcccaggaccacatggattcactggataattctactaaacatttaaaggagaactaacatcaatgctttttaaactttcccccaaaattgaagaggacagaacacttccaaaataattttatgagcctagcattaccctaataccaaaatcaaagatactacaaaaaaaaaagaaaacaaacaaacaaaaactacagaccaatatacctgatgaatacaggtgcaaaaatcctcaacaaaatactagcaaatgaaattcaacaatatattaaaaggattgtacagcaagaccaaatggaatttatgtttgaaatgcaaaaattttgttcagcatatgaaaatccatcaatataatatcccatgttaaccacatgatcatctcaatgcagaaaaagcatttgaaaaattcagcaccctttcatgattaaaagaaaaaacactcagccaggcgtggtggtggctcatgcctgaaattccagcactttgggaagctgaggcaggtggatcacctgaggtcaggagttcaagaccagcctaatcaacttggtgaaaccccatctctactaaaaataaaaataaattagctgggcatggtggcaggcacctgtaatcccagctacttgggaggctgaggcaagagaatcacttgaacccaggaggcgaaggttgcagtgagccaagatcatgccattgcactttagcccagtcgacagagtgagactctgtctcaaaataaaaaagaagaaacactcaacaaactaggaatagaaagaaattacctcaatatagtaaagaccatatataaaaggcccatagctaacattatgctgaatggtgaaaaactgaaagctttccctctaagatcaggaacaaggtatgcatgctctctctcaccagtctattcggtataatactggaagtccttgccagaggacaagggaaagaaacaaaagtcatccaaactaacattatttctgtttgcagacaacctgatcttgtatgtggaaaaccctaaggattccacacgtacatacaaaactgttagaactaataaacaatttcagcaaagttgctggatataaaatcaacacacaaaaataagttgcatttctatacatgaacaatgaacaatctaaaaaggagatttgttttgttttttatctttctcctcatcttgtctttcatttacaatggcatcaaaaggaataaaatacttagaaatacgctttactgaggaggcaaaagacttgtgaactgaaaactatagaacattgcttacagatattaaagaaaacacaaataaatggaaagacattccatgtccatgagttggaagacttaatgttgttaaaatgctcatattttcccaaagtgatcttcaggttcgatgcaatccctatcaaaaccccaatggcacattttgcagaaatagaaaaagccattctaatatttatatggaatcttaaaggaccccaaatagccaaaacaaatctgagaaagaaaaacaaagctgaaggccccacacttcctaatttcaaaacacattgcaaagctacagtaatcaaaacagtatagcattggactaaagaaagacaaatagaccagtgaaacagaatagaaacctcagaaataaatatattgtcaaatggtctttgacaagggtgtcaaacctacaaaatggggaaagaatggcctctttaacaaatgttgttgggaaaactggatatctacatgcagaagaataaagttggacccttaccatataccatatataaaaattaactcaaaatggaataagatctaaaagcaagacctgaaactataaaattcctagaagaaaacataaaaggaaagctttatgacattggatttggcaaagatttcttggatatgacaacacaagcacaggcaacaaaagcaaaaatagacaaacgaaactacatcaaacttaagaacttctgtgcagcaaaggaaatagtcaacagaatggaaaggcaacctaagaaatgggagaaaatatttgcaaaccatattatctggtgagtggctatacagaatatacagagaactcctctaactcaacaataactgaatgaataatctgattttaaaatgagcaaaggactttaatagacatttccccaaagaagatagacaaatggctgacaaacatatgaaattatgttcaacattactaaccattagggaaatgaaatttaagccaccatgagatatcacctcacacctgttacaatagccaccatccacaaaacagaaaatggcaagtgttggtgaggatgtgcagaaactggaatccttgtgcattgttggtgggagtgtaaaatggtacagctgctataaaaaacagcatggaagatcctcaaaaatataaaaatagaattaccatctgattcaacaacctatttctgggtctatatccaaaagaaattgaaaacaggatctctaagagatatttgtataccaatgttcattgcagcaattattcacaatggacaagaggtagaaacaacctaaatgtacctacatggatgaatggataaagagtatgtggtacatacatacaattgaatattactccacctttaaaaaaggaaggaaatcttttcatatgctacaacatgaatgaaccttgaagacattatatgaagtgcaataaaccaacaataaataagtcattaaacctataaataagtcacaaaaagatattactgcatgattccatttatatgagatatttaaaatagactctcagaaacagaaattaagatggtgattgtcatgggctgggggaaaggagagttgttgctcaatgggtgtagcgttgttgcagttttgcagaatgaaaaagttctagagttctatgtgcacaataaggcacatatagttaacactactgtgctgtatagttagtggttaagacagtaaattttatattatgtgttccttactacagtgaagaaacgaggggcatgggagtttgtgtaagatttatacagagcaatatgaggtgtatagtaggacaacaattaattggtaactgtaatttctttttttgagattgagttttgctcttgttgcccaggctggagtacaatggcgcaatctcggctcactgcactctccgcctcccaggttcaagcgattctcctgcctcagcctcccaagtagctgggattacaggtgcctgccaccatgcccggctaatttttgtatttttagaagagacggtgtttcaccatgttggccaggctggtttcaaactcctgatctcaggcgatctgcccacctcagcctcccaaagtgctgggattacaggcgtgaggcaccacacctggcctggtaactttagtttcatatctttccattagaagaaaataaaacatggtccccctcctgccatatgcccagcgaggcatttccaaccacccattctctgctttattttttttaggagctcttaccacccaacatattacatatttactaacgtatttgtttattttctttgaataaccagacatgcagactcccagaagacaggaatttctttctttcttgtgtattactgaatcctcagaatcaagaagagtgtgtgcctacatgaggtgcacaatgaatagttgttgaatgaatgagcgaatgtggaggttaggagagccaaagggcagctgaagtctggggttttctcctatgttcttccatctacttggggaagatagaaaagaggagagggaggaagacatgtaacagactaggaaggacagatgtcttttcattgggcttgtgggggcagccagatcagcttgagaagtacgaaggatgaggaagatccatctactatacagtccctgtcccgggtctcttctgcttaagcaaaagatggaggctatgaccactaggtcttgccagtttggtgtagctgttactgaatcaagagactctacctgttagaataaaaagtcttcattgttcccactttttatatcctaggtcagtgggtcagtgcttctcaaactttaatgtgcatacaaatcaccttggcatttagtaggtctgggtggggcttgaaaacctgcatttctaataagcttccaggtgatactgatataaattcttgcttatagtggctggttctcaaccatgtggcacctgggaagctttgtaaaatcacagtgtcccaattaaattaaattaattaaaattagccctctgggagtgggaccctggctatggtatggccgaggttgagaaccagcactccaggggctcttccaaggtcgctaactctaatggaagccattgttttggaccctgtaggccttctttccagctgttgtcccctttctccacaacctcaggactgctgagacttcactattgctgctgagcgtctgctgagagccataggtgaacacaggcacgccttgatcttggatatacaatagggttagttaacactctcaggcagctggaaggaatttttctggtttttttttttttttctacctcctgacttccacttttcatctctctttccagctggtaggaaaatatcctcttccagtctagcagaacaacggttctaaatttgggggcgattttgttcccggggatatctggcaacgtctggagacatttttaattatcacaactcagagtagggggccgctactggcagctggtgggtggattctgaagaggctgctaaacttcccatgatgcacaggacagtgctccagaacagtgtccagcccaaaatgcccaaggctgagaaaccgtgcaggagaagggagacccacagctgagcctttggggcacctttttcatctttaccaagctaccctctcctccaggcaccgaggtccgggatctgcaggggacaaaatgggatgggctgcgtccaagagtagcctcctgctgtatccagaacctctgtcttttcttaccctcaagcagcagggccctccctgtccagcccactccactaatcctcttcctcatgcaaagtgggtgaatttcctctctggtgctaatttatctccctcagtgttttaattttcatagaacctcctcccacccattataaaggtctacctatttcctctctggtgttactttatctcccccagagttttaattttcatagagcctcctcccacctattacacaggtccacctatttccataccccatctgtgctcaggattcaagttctttctcatgaaattcctacacccatgcaaatcagggctggggccagtcatcctgaaagttctttgagaggtgaagggcatcttaccaggggacagagaggcccactagagggaggatagcctgatccccaaatgccttcctaatcccatctcaatggcaactcgggcaagacaccctgtcatatatgtcctgggcacttgctaggtgaaggccctgctttaagtgctttgcctcatgaaattctcccaagagtcctggcaggtaggtgctaaggtcatccccatatgtaatgagcagcctgaggttaagtggtgctatttttgtctgtagttcctgtagttcctaactcctaaaatccttgggatctcccaagtgctgtctttcttttgtgtgataggttcaaagtggggctgatcactggaaagaataaggcaggattagagggttgggacttaacagctccactcctgaacctccgggaaagggacaggggctgaaggttaagttgatcaccaatggccaatggcttaattaatcatgcctacgtaatgaagcttccctaaaaacccaagaggacggggtccagagagcttccagagagcggaacacgtggagattcctggaggtttgtgtgcccagggagggcatggaagctccaagcccctccccctacaccttgccctacacacctcttcatctaacgttcatctgtatcctttgtatatcctttataacaaactggtaaacgtatgtgtttccctgacttctgtgagctactccagccaattaatcaaacttaaagggggggggttgtgggaaccccaacttgaagccaattggtcagaagttctggaggtttggacatgtgactggtgtctgaagcgggggggagtctcgggaactgagcccccaacccatgggatgtgactctatcatcaggtagatagggtaggagttgaattggaggatgcctggctggtgtccactgcttaatgtgtggagaaaaaaaacccacacttttggtcacagaagtcttcctctgtattgatgattgttgttgtgttggtggtggctgtgtgagagcaggaaaaaaaaacaacaacatggcttaagagagcttttccctaaacagtaagagaccaagtaagttgtccaaggtcatacaactaggaagtagtagagtaaggttgtgaacacaggcagcttaggtccagaacccatgggtttaaccactacactgtacagtcccttatgtgcttgacattgacaataacccaggcaggcttggattctgctgttggttttgaagatggaatccagttcctcaaaggcaaaataatcttccaaaatcactcagctagtaagtcatggtcctgggattcaaatccaaaacagaaattccatgcttaggccaaggaaggaaattataagctttagaagatggcaccatttatccattcattcattcattcattcatccatccatcatgcactcagcacacatatattgatgcttcctgccagtgaggcttgttctgtgagctgaggatccagagaaaattcaaccattttgaatttatgtctgcttggaactcacataaaatttgggggacatgccacaggctggtgggtggactaggagaaagggaagggcataggagtgcagaggagtccatttacacttgtcttctgggagactggacagatatggggatagggtctggagaaacccaagggtccactgctcatgccatcggctagtcacctgggtcagatgatccaggtgacaccctgcctcctggtgcacacttgcacactttcatgttgccttgttttctccccatttgtcttctcattggcttgctcagaacttcccattcataagcacagcatggggagaaacaagaaggggtctgtgctcccccagtggatcaatgcgaggttggcatcccaacttatcattccaaggtcccagagagaaaccaaattgtaactgtcaggaacacaacagaactgtcaaaagcagacaaaatcagccacataaattgtgaaacaaaagtcacagttctatttgttctgcaagagtgaacatctcacatttttttgtaaagatggaaaataaaaacaaagaccaactaggggcattgcaagcatttcatctctgtggagaaacccaccaccagaaaatctcagtttccatcaatgccccctccccataaatctatgtctacttccatgacttcgattcagtaaacactcagggagtcttacaatgggaatgagtgtgtcaatcatcagaaatgattatgacccagtccctgcccttgaccatcatatatccagctaacgtaattagaatagagccaggccagaccaaataaagaaggccaactcagggagtgacaaatccctctatagtggaatcagggatggcttcctggcagaggtaacatctgcattgggtcttaaaagatgaataaaatttcacaagtggaaaagggagggaaggaaacttcagagacaggggaagacagatataaatgcacagaagctgaggcaggtagagagggaaggacatggcataagaggtactttggaagtcaaatctccattttgtgcaacaaccaggctgggaaggttagcccttggccagggaaacttgccctgccatcaggcatatggggctccttcatttggacggcaggtatggcgctcacatgtgctccagggcacacacaggtaggccatgcacagatggtgcaagcacacttcccatcaaccttggctgtgtgtgtgtgtgtgtgtgtgtgtgtgtgtgtgtgtgtgtgtgttggcagcaatttggcaggccgttctgcagaagccctgcagcaccgtggttgctcaccaaaatagcatcaagcaatttaggtcaggaagtaaggactgtgttattattactagttactgaagttatttaataagaatgtcacatccaattgagaccatggtgggaactgtcagcaggaagaatgtaattacactaactggaggtgctccacagatccacacagaggtggactctcccccagccccactgtcttctggaaggaatttctttaggtgaggccatcatgccaggccccagaagagccagacatgctgctccagttcaggccccgggagggcttttgagggggagatctccaggacccagtgggggtctgttcagtgacaccatccatgacctgacatcctagtgatattcagaagggagagggttgtgaagccccagcctcacttcttcagctccaaagaaaatccaacagacatcactgcagggcatgggaaggccaagagtccgttccacccatgccctcatccagacccactccagttgcccacagcagtagctgggttggagacaaaccctttactgatgactctcccttaccattcctcaactggtatttcttggaccacctccaatttaaactacttacacttaatccttgtctcaggtctgcctccggggagctcaacctaaggcacttccggcagctcccaatccattccctagaaaataaagccgagctcttccccacagccctggactctggctgagcccacctagcacatacctcctgctgctggttgagacctgaactaaactacctccctgtaatggggctaggcagaacccaaggatccttgcccatgagcacaggctctgtgatcctctaaggccacggttatgggaggtggcacagctgaagcatttcatggggggcccagcctgcagccactgcccatcccccaagtattatgtgtgggacacaaaaggtgctgtgctcccattttgcttcaaaatctacaccctttgggatttctaagagtcctgtgccctcgctcccttgtagcagcagttagacacccagacgagggagatggggagggctgggagacactgcaggagggagtggagtgggaaagaacactgattctcgctgtcaggggcatcacagctagcaaggcaggctgtccttgtggccaggaggaaggaaacggaggcaaggagagactcggggagagagagagacataggggagagagagagacatagatggggagagagacgggcaggggagggaatagggacacagagacaggacccacagagacagccaggtagaaagaaagacagagcagagaaaatcagggactcaaagaaaagaacaggcagtaagagagatgggcagatagaaaaagagacacaacggcagatagagagtgagaccgcaagccagggagatgcaagaggacagaaaaagaaacagagagacggaaaagtgacagagacacaggcaagaggcagacaggaacagagagaccagatagggatagcggaaggcaacgagggcatgacccagagtgagacaccaagaagccacgcacagcttcacaacaaaggctccgtcagcggcatccgaccccccaggtccccatgggagctaagtggaagaaccagagactgagtatggactatttgaggaacttagctttaaatggcaaagaacagggcggcagccagagaggagttcagggcccaaaaagcttctaccttctattttgaacctgttttaaattcaaggagtgaagtcagtggagaagaaaaataaaatgggagggtagaggggagagaaggggcatatcacaaagaagacagatggaagaaaggggtcctgggctctgggaactggggactgtgggagagaccccacctcttcctccaggagtgaggggaggaggagtggctgcagaagcaggtaaccacaggtaggaggaggatgtggaagtccattctgatggtctgcctgttctcagtgaggtaccagggtagtcatcctgtgatggaaccagggatttgtgccttggaatggccactcttaggattaggacaggaagctgaccaggtggccgatagaaagatagttaaggggtgctgggcgtaggttagagatgtgagttcgcagtggcagcaggattcatagtccaggtggcaggcccagagctgagttgcaggactgacccagggctggagcgtgtagagactgagggtcctagtgggacagtggttcaagggatgcacagtggagactggccggccttggtaaccaaggaaaggggctgctctgagaggagttgttgagagtctcggggtctccagcatttgaagggaccttgcatggctgggcaccaccacacccatcgtcccaccctcttctcaggccagcaagacctccatttgccccttggctgcagttcttgatttcttccttgtgggaagtggcctcttcctccaccttctcagcaatcggcctcaccgacgccctgacctcagttctgctccacacccaagaccaggggtgtccttcctcccacattccctctggactctgagctcaatctggacctttttgagggcttctctccaagcaaaacccaggcagctgacccctgcctgctccacttagcccccagcactggaagcttctgaggctcctccccagagcacctgaaggactgagtgcagagactgaggcggaaaacctctccggctcaactcagtggtgactcttggtagaatttgtgggaatcccatgtccttcaaagactgtacccgcaggaagggatgctgcgctcgggtctgagggtgtgtctcctaaccttcctcctccctgagaaagcacagacagacagtgagggctccaagccagcacgttgtcgaagtggtggcagctccaccaaaagagaagacctgggtgttcaaagaagcctgaagttcaggcagaggcatagacctgtcttgctgagcacagagcaccaggcccccgcctccctgaaggacccacacagcctggcaggctctgtgcagctgtcggccttgttgagccctggctgttaccaggcatggttgtcaagtgcagactcatatcctgggtcatcggggagtgagtagaccggcttttgttcccaggaaagccactccacacagagcctgaagtgtagtcaggaggggcgtcgtccctaaactctgccagctcagaaggacagtgactagggatgggggaggttcaaggtcaaagcctgacccacccttggggctggagagctgggagctggaacccaggctaagcaagatgctcacaactgcccaagtcctggcatgcagaattcacacctgtgcacacacacatcaacagctacagaaacagacgtccacgtccactacatacatgtgtacccccccccacacacacacacatatacattttgcacacacggttctcatgcatacagctctttagtacgtggctgcatgcccaccctcccatcctggatggaggctccatgggtcccgctgccaccccctccctccactagggtatcagtgcccttctggaagaatctgtgtaaaggtctgggtgtcccttccacctgatgttgtgtttgtgagtggtaaagcagtgtacctgtcttgtgaaactgtgtatgtgaacacatgttgtgtgtagaagcgtgtgtgtgtgcacatgtgcttacatgtatcagttacaatacatggaaggatatgtgtaaatagggaggaatttaaaagagcccatgataggctgggcgcagtggctcacgcctgtaatcccagcactttgggaggctgaggcaggcagatcacgaggtcaggagatcgtgaccatcctggctaacacggtgaaaccccatctctactaaaaataaaaaaaaattagccgggcatggtggcgggcgcctgtagtcccagctactcaggaggctgaggcaggagaatggcatgaacccgggaggcggagcttgcagtgagccgagattgcgccactgtactccagcctaggcgatagagcaagactctgtctcaaaaaaataaataaataaaataaaataaaatagcccacgatagctgggattgcatcctcaccactgccctctactgcagacatgcacatgtgccagggcctccgccgctctgactggctcagtgctccctgcacacacagagcatccggcagcactgcaggaaggaacaagcctggcctgcagagtcagacaaaactgaattcacagtcccttctgccacttgctggctgtgtgacctggggcgccctgctcaccctctctgagtctcagctccctcatctataaggaaagcataatattaataatacctccctcacaggcatgctgggaaaattaaataagattatgaacatgagactccaggccctggggagctcaagaaacattaattaccactcattctctcccttccactccaccctgtgcctttcattcatgcaactgataaatatttatcaagtgctgtgtgtggcactgggggtacagagtccctgtagtcatcctcatgcagcttgttgtctagtgggggagacagacagtaaacaagtaaacaacagtagatcatataatgagcatgatcagagctatgaagaaggtgatgtagtccttcatctactgtggtcacctctgacagtgccatccctgagcaggtatctgcagggtaagagcgaactgtttgaagatgggagagagagcattccaggcagaaaaaaacagcaggaagaaatgtctggaggcaaaaaaaaaaaaaaaaaaaaagtttgttgttttccagtaagagcaaaaaggcaagtacacctggggtatggagaagcatgcaggagtggtgggaggggaagcgtgggtagactggcagtcaaggccagatcaaatcgggatggtttcaactgtgtgtatgcagtgggaggggtgaccgaatcagatctgcatgttttaggatttctccagctgctgtgtgaagaaggaaccacaggtgagaacaggggaagcaggtggaccagccagggatcgattgtcccagggagagacagagaaggctttaaagactcaccctgctcagccctgcgctcaatgccttccctgccctccacccatccttaggctcctctctcaggatgtctttcttctctgatgactcctgactatagcatccattttccaactcttggagcccgttttcaagggcctccttcccagaaacccgtcccaggtccccatctccgcacatccacagcttgcttcctggtttaaaggacaaaccgagaccatcctatccaggaatcaagaaaaaaatatggcatctgattctcctttatgtatctccccaccagatagagcatatagtaggtgttcaataaatgcttgcattcaatgtggtacctgttcctttctgcctagcattccgtacccttccctgctcttgtttctccacctcccacctcaccaagcaatgcttcatttttgttaaacattattaagtacctgccatgcactaggtccctgcaagtgcatgctctcatttctccttcctgactatcccatgaggcaggggctattataaccccactttacagatgaggacactgaggtgaagagaggttggcagagccagccaatagtgaaagtactagacaagaatgaattatacctgacccaaagtcaaagttctgtctgctctattgggaggtgcaggagaggggggggtcttaatttttcttttcaataagcaaacagggaaatatatcttgcaagttacttacacaggccagcctgcctggggatgtccctgtcttgcactctctaggagagtgtgtagaccagaccctgcctgctgacttggccctggtgtcatatcaatcttggcatcctgcaccttcttccccaactccactccagggacctagcttgaggggggcttactcaccatcaggaactgcaggaagtggagatcaggttgaagccacagactcatgctgacacccatccacagcctccaggcccaggcctctctctgaggcagcacagagtggggatccctgaggccaccatcaccaagttactcattcctgatcaggcataaaatttccttcttgttttcaaatgagcccaggccagagtctccagtcagggggttcttctgcctcccatccagtggcacagctctgtctttgcacaagctcacctctcagcccacacaccctttcccactgcaatgcaagggtcaggatcccctgaaaatacttctgagcgctcactcggggttgcctaaatcatgagctagctggggccaggggcatccaaattcagcttcccaagagacaagagggattccaacctctcatgggccacaaattcccccaagtatgggacagctaaccttatagacaattcctaaaaacagcacacacccaagcagcttgcatgtcccttcactgatgaggtgactcacacacttgacctgtaaggaggaagagcaagagagagggaggactcgcctctggaacagactcgggatggatgtcaggcagaatatcatggccccagcacacccctccatggacataagggagaatgggagacctgtggcacctcgtcctgctgacccttagtcagctttcccttcccctaataaagccccgattcactcttaccatgtgacattgtggaattcatcccaggccctggtgggtaacaggtggcacccaccgagaaccatcttgcttgttacccacttctctatcacccctcttcttctgattaagacccaaatatcccctcctctgggacctcccccaggtgtagttacttgctccctcccctctgttcctgtgatagttaactttatgtgtcaacttgactgggctaaaggatgcccagatagctgggaaaacattatttctggatgtgtttgtgaaggtgttcaggaaaatattagcattggaatcaggagactaaataaaacagatcaaccctcaccaatgtgggtgggcctcatccaattcattgaggtccccgaaagaagaaatagacagagaagaggcaaattctctctccttgagctgggatattcccctgccataagatatcagagctcctaattttaaggctttcacactctgggacttacaccagggttcacccccactatcccacatccctttcctcaggccttcagactcagactgaattacaccatcagttttcctgggtctgcagcttacaggtggcagattgtggggcttttcagccttcataattgcatgagccaattctcataataaattttatacacacacacaaacacacacacacaccttttttttttttttggttctatttctctggtgaaccttgactaatacagctttcaaattaattcattcaatcaccaaacattggttgggcacctcagtgtcaggcctcatgcttcgtcctaggacagaatgacagataaggcatagttcctgtccttgtaaagtctagcaccttctattaccacctctctccctcttttgcaataccacttgtttctgtatctagctgtccactagactgccagttcctcccaagccagtacagtggcttgtgaatgatatcatcccagtatctagcactgaactctgcacttgaagttgtctgaataatagaaaagcaagccttgcaaaataatgatggttccattaattcagtcagcccaggccgggtgtagtagctcacgcctgtaatcccagcactctgggaggctcaggtgggtgggtcacctgaggtcaggagttcgagaccagcctggtcaacatggcaaaaccctgtctctactaaaaatacaaaaattagccaggcgtggtggtgggtgccagtaattcctgctactctggagtctgaggcaggagaatcatttgaactcaggaggtggaggttgcagtgagccaatattgcaccactgcactccagcttgggtgatagagcaagactctgtccaaaagaaaaaaaaaatcagttagcccatagttacaggttgtgcaaaaggctatgtttcacactttcccatcccttgtgttcctttcccatagtacatcttgctacttagtcaaagagagcatgcccaagggtagggagtgtgaatataaaactcgggcaggctgggtatggtgactcacacctgtaatcccagcactttgggaggccgaggtgggcggatcacgaggtcaggagattgagaccatcctggccaacatggtgaaatcccgtctctactaaaaatacaaaaattagccgggtgtggtagtgtgtgccaatagtcccagctactcaggaggctgaggcaggagaatcgcttgaaccggggaggcagagattgcaccactacactccagcctgggtgacagagtgagactctgtctcaaaaaaaaaaaaaaaaaaaaaaaaaatactgagcagctctggcagccaaacaggcagaaataggagggagcatttgtgtgctgtgatgcctcatgcttgtggtctccatggttctcttggtgcctccatcacattagaaacatctgtttgcctgacaacagccaacactctttgccctagatcttcaaactcttctttaaatctcaacccattatagtaatagtctggagaggggaaagccatgaaatgggagtttcttttctctctgacaggcctaggggataaagaggccgcaaatatccctttaggttaattcagaaatgtgaaaacttcatattttcatttccaaataagtagtcactacattaccatagtaacatttgctgccctattttagattagaaattattataaaagaaagcatcaagacacattcattgttaaattgtatataatcttaaagggaaaaaggtctttctctaagtatgacacaaaaccagaagccaaaacactgacaaatttaagtgcataaatatgtagaatctctctatgcaaaaaataaaataaagataccacagagtgtaaacacaggtccaaactgcaaaaaagatttgccatgctactacagattaaagagccagtgtcttttatatgcaaagagttcttataaatcagtaagaaaaatagaaacaatgccatagaaaacaagcaaggtgcataaacagatagttttcaggagaagagatacagacaactgggaaacatgaaaagatgcttagtttcagttataattaaaggaacgcaataatgagctacttttctgatttccatcagattcgcaagtttttaaaaagttgttgggaaaggatggagcagtggttccttgaccagcacatcagcatcaccggagaacttgttagaaattcaaatactcagatctcatcccaaatctactctactgcagacctatttgatcacagattcactgaatcagaaactcctgggccaagcaatctgtattttaacaagatctccaggtgattctgatgtactcgaaaatgtagcgttacaaagaactttcaaatactattggcagtgtttaaattaatgcaaattggcaagtttatcaaatgcatatatcctttgaggcaacaaatccattctatagacatctgccctcatgttgaaatcacacacacacacacacacacacacacacacacacacacacacaattattttgttgtgatattgtttggggtagcccaaaactagaaaaagcctaaataataaagaactgattgactcctgtaatcccagcactttgggaggccgaggcgggtggatcatgaggtcaacagatcgagaccatcttgaccaacatggtgaaaccccatctctactaaaaatacaaaaactagctggtgtggtggcacttgcctgtagtcccagctactcgggaggctaaggcaggagaatcgcttaaacccgggaggcggaggttgccgtgagcagagatcacgccactgcactccagcctggcaacaaagcaagactccatctcaaaaaaaaaaaaaaaaaaaaaaaaaaagaactgattgactaatttacagtaacttatgaaatatcatgtagccactaagaggaatgagataaatctatgtacacctacccagaaagaggtataagagacatttctaagagaaaaaagcatgttacagagtaatgtatatgatatatctacaatgatcccatttttgtgaaatataatttgtgttccatttacattttcttacatgttttgaaaatttctgaagtaattcagaagaaactgttgataagtgggactgggctctgcagtggggagaagggcttttttcaccatatgctcttctatgccattcgaatttttgccctgagcatgtattacttctatagtaattaaaaagtagttataactaattaaacttaaagggaagagaaggagcaagcaggagagagaggcatggctggaaggggagaaaaattaggtcatttgggtaactgcatcctgaagactatccaggccctgcctgagaaactcagagatctggtctatactttatcttcagtcacacaggttgctctagtaaagaaaacttaaaaactatttcactgaactggtgactttcaaaataaattacttatttaactaagaaaaaacctcacatccattaaacaaggcaacccctaagccacttgattttccttcctgtgggttcagcccactcagttgaatgtgctgtggatgttagccattgagtttcttttggttccaaaaaaagtgtgaacaagtgttatctattaaatattacatgtgagtgtgaacgccagtgtggacgtatcccatatttgcagatcagagatcatgaagacagtgtttgtgcatgagaacagacacagtctttcacagagctatgtgaacatggtctgtgctggggttacaggcctgacatatcatgatttttcattaacggcacttgttagagaaacttccttgggataggagcctggactcctctctgcatcattcgcttgtcaattcccatgatgcctttaataaaattatccagttcagcctttattaccattttttgtccagccaatccccaaatgagtttgcttaaacaataaattatgaaaactccgatccatctattattcaatcatccttccatctaccaaccatgggtctttcctcttgtacattcatctgtctatatgtctactcatcccatgaatctacttgctgtccattccatcatttgtttcattcagccatctcatttcatggctataatctctatcaagccaatcctgccatccatgcattcacccttccactcatctttccattcactcatccattccatccattgatcccatctagcccatctattcttccactttacccactcatcaatcaaacacatccttccatcctagtcatccatgcatttatccatccccccatctaataccccatccacttattcattgatcccaaatacccatcaatgctctctagcaatccatcccatccacctatccattcttccatcacccactatctctatccatcccatccatccgtccacccatccattcagcaattgcacctcttcatcccaccccatagcctagacttacttatctctctggaggcaaagagactgcggcaagcaaggcccagtgagtataagaaaaaaaaagtgactgaaaccttattactttttcaacaaggcccactaagctcttttcaccagaacatctttgagcactcttaacagcaagtctttttccacacttatatcccttctcttcctctcatgcccagattcccccgctggtctctgaccagctgggacttctagctaccagtaagagtaaacacatcaggctcaaaactaccctgtaacctccagtgtccattctgggcccagctaactatgctcccttccctccttcacccttctgcctttgaactctagcctggggtgaagccctagccatgacaccagcgctcctggcccagtgtatagcctgttccagcctggcccaacctggcccaacctggctaaagcaactcacaatccagtgcttcgactgaagactgtgctttccaattgggaaggcaaggaacctaacatgtaatagacacctaatacaagacagggacttgtcaagtgctttctatttgacacctaatttcatcttccctgcaattctctgagttaggtaaaggggctcagaggagaaactgcgttcacagaggttaagtaatttgtctaaaatcacacagctgctgagaagcagtatcagaattcaaaccccagtctgactctaaagcttcagccttgccactccaacaagctgctattaagaggacaatttccaagctaaaccaagtaggggaaaccagaatgataagcaagaaaacatcccattttctgaactgattctctaaccaagaaaacacaatcatgtgaatcataagttgtagtatttactaagtggtaagtctatgtcaggtgctggctaaacaagctttctatttatttaaaagaaagtgaagtcccttttatgatccttctggggggtccctccacatactatggttaagcaggtcccagatcaaggttttaagggtttgaggcatgtacattgtactttggaactgtacgatttcctccaggagagggatttgaatgacagatgtttaccttgatcacaagcttgtcactaaggtaaggaatctcatatgtttgcaaatatgtagaagttcaaatcctgctacaccacttgctgtgttactgcagccaacctccttcacctccctgagcctctgttttctccatctgtaaaacggaggtggtaagagtaaccatatctacaggactgtcaagagacttcaattaagattctgatgtaacagcttaacttctctcttacggttggccacttatttcattttcactttttccctcttttgtaagtaatgctatgcatcttctacataaatggttgactacatgtctgattatttctttagggtaaattctttgaaatgaaatatcgagtccaaatatatgaatattttaaaggctgttgataatatagtgccaagttgctttccagcaagtttgtaacaatttacacccctacaggcagtttattgaagtgcccatcacactgcacccttgccagcatatactcctttttttgaaacaatttttatatatttttacatacacattcatatataaccttgcatgaatgcataaatatgatcttcttgtgtatcatattgggatttcagtgaaattttatttttatttttccttttcatattcgacttcctctccatcaccccccatcctcacctaaccccatgacccactaaccaacactcactcctaggcaacccatattgaagtctagtttttattttcccaaatctctatgttttcttataaaaccacatgcatactactaccatttgaatgtttgtcccatccaaaacttgtgctgaaacttaatccccaaagtggcagtattgagaggcagggcctttaaaaggtgagggcctctgctctcaggggtgattaatccattcatagattaacggggtaatgggttaatggattaatgggttatcatgggagtggaagtggtggctttgtaagaagaagaagagagacctcctggactggcacactcagcccccctcaccatgtgatgccctgtgccaccatgggactctgcagagagtccccactagcaagaaggccctcaccagatgcagcccctcgaccttggacttctcagcctccagaattgtaagagataaattccttttctttataaattatccgtcttcaggtaattttgttctttagaattttgtggttattctattataagcaacagaaagtttgtggcaattttgttataggcttcagatttttgtggtaattatgttataagctacagaaagcagacagagtcacaaacataaactgacatacccacatatacacatttacatatacagtaggggtttgccattgtttgtttccttaaaattgtaccacattatacaaacttctcagcatctttcttttctctcagtaataatgatgtttccattaagtgaaggaataatgtctacagagtacttagcacagcggctggagcactgagtacatcttattcattgttgttgttgttataaattaaaaagacaaactggcatccctcctaaagctgtgagattcatgggtaaagtggctcccctgtcctgccagtcttgtgtgggaaggaacaggcaaaggcaatgttttactagagttgtgcatgtcatttccatggtccctaaatcattcttcatattaactaatggcctactatttgccagggaccatccatggtccagaggtaggataataagcaaagccaggcaaagtccctgacctcctgaagcttccagtctagacagcaagcttgataataataaattaatggctttgatcaatgtatcatgatcaactgagataagttatccaagggcaagacacacaattctatgagaatgatttagactgcgggggcagggggccttctctgaggaagtgaaacttgagccatggttaatgcagtgaaaggggaagataatactccagacagaggaatcggcatatgcaaaaaaacaaacaaacaaacaaacaaaaaaaaacccagcggcagaagaaagcatggccctgtgagcttgaaggggacagcaggctgaaattctggctctccgagcaaaggcaccgccacttgcaagcaaggcctggcaaatgtctagagaacacctgcagcctcaccaagagcttcaaggcaagtgttctcccaatgcctcggatcccactgtgtttagcaggtcccatcaccttggcaaccacgagggagtaccaggccaggcctaggtaaatgcatcatgtatatcatctcactgcattgttacaaaggttttgtgaatgaggcactactgttcctgttttagagatggggaactgaggcctaaagagattactatgccccttacacaggctagtaccaagcagggacaggatttaagcctgggtctctcccaatctccaatctatgcctctgagaatatagaacagagaacaacacttttctctgaggtcctaagcaaagatttcataccctcctcccagggtgacttataagtttttcacgtggggctgggatttgaacccagctgggctagctccagagaccaggctcataatcacttcccactgaacagcctttcccctcctctacaacctgtccccctccagcctcacttcctgcagccccagccaccacacacacacaaggaacactcgaacacacagaacttctcatttcctcctgtgaatatagggccttttgaggtttggaggctcttcctgggatacatcccactcctttcctcccctgaaaactacctgctccaccttttaagtcccatctcaaatgtcacatcacccaacagtgaacctacccataccccccacccacccccatacactggagttattaactccatctactgggttttcatgtcttggttctccctctgtattcattcattcaacatcccataaatattcatcaagcccctactatgtggaagacactgttctaggagttgggcataccacagagaacaagatagacaagctccttgatctcatgggatttgcttgagaagtcagtaaatgtttcaaaatgcatacatcctatgttgggtggttctaagaactatgaaggaagccagagcagggtaagcgaaggaagggattactgtggatgagggggttgaggaaacctctccaaggaggtgacgttggaacaagaatttattgaagtgatggctgggccttgtggctacccaggggatggagagccccaaatctatttgcatgcatgccccaacacccagtgtgtctgaggaacagcagagaagccactggccggagcagagtaagcaggagcaagtcttagggggatgaggtcaggaagaaaatgaggggtgagcacatggaaaggaccttgacttatttctgaatgatgccaggggaatgaatgatctgcctaaccatgttcaaagctctccagctgccaggttggaggaaaatggaaataggcgagaatgcaaggagggaaaccagggaagggtccaggcaaaagaagaagatggctcggacccttgggtgtgatgtgggtggcaccaggggctgggatcctggatttattttgaaggtggagccaacaggatttgctcatggcttgatgtggggagagaaggaaagggagaaagaggtatcaagggtgaccaccaggtttctgggcaccacgttgcacggtgactgctctgatgtgcctccctcatagaaatgtgagctccttaaggcagggatgctgtcttccctctttgtgacactgtacagggcccaccccatacatgtttgctgcatgtgtgagtcatgaagtgtccctaagcagcttctctgagccattcttttgctgccacggcctttggggaagagatgggtcatcctgtcctggcggccccctcagtctccaaataggttatctttacacatctaataactacgagcaaatgggggtacactcatccagagatgaacggtctgcaggatcaaatcagacaacttgtccttggagccaaggcccaagatcggctcttctctgccccctcagtctcctttcagaagccacctggtgccccaggagacgcaagtcctgaaattcagctgcaagcaccttacaagcccagcggaattggcctttgcaaaaccctggtgatcccgtcaccatctctgttcaaggcaggcagaaggctgtctcctttatagagatgagaaaacgaaggcctggaaagtggcagggggtgatggaagaagagaatggccccctctctccatcttcttgcatgaaattgtatcaggaatgaaatagtgttccactcagcagcatgggctttggagtcatgcagccctggatgtaactccaacatttaccaaccatgtgtgactttttgtgacattacttaacatgattgaacctcgatctgcccctctgcaagatggggataataatgccatctctcttacggacctgttttaaggtttatattagatggtgtatacaaaatgcttggcacagaggctcatggtagggactccatacatgaagatgatattatcagtgctattattattgaaatggtttgtgatttgtgccactgctggactctatctagggctgcgacattgtgtgctgtgtggaaacagctgtaaaaacatgattaagaaaccgcatgtggatgctgttatgtggtaacaacagtcccagctccatcctttacctgctgtgtgatctttgggcaagtcatcttattccaccaaatctcagactatgtctataaaatgagaatcattatactacctaccttcagtggggtctggagcccactgaatatgataatcatataaaaatctagcacagtgcctgggtacagcaacgtgttcaacataatcagagtcagaatgagactggcacctcacgggtcccagtgcctgtccacccagagcagcagcctcccaggccattaacaataatagctttaccaggtgaaaaacttgcgattgactcttctcagtcttttctacactaactgccccctagacctccaggtctcagtttaacattgcctccttcaggaagtcatccctgataggcgctggctagactcctgaccttcctgtgtgctcccataacccctctccttgccccgtgttaaactttattgtgatgctcaccacattgcttttaaattatctgtgtaattatctgtccactctgcaggtgatatattagaaagactgaaagcttagggggatgtgggccaaaggacagatcccatgcatgtcatcaaactctatatcccagaacccagcatggtatctggcacaaggtggtagctcaacacaacttggttaaacatatacacagatgggagaaaaaaagaaggaaggaaggaggggaaaagtcttggtgttgctactgctttatactagtaactgtctctgtcatctccagcctgctcctcttgccttgggtctattattcaagtcaattttggccccttgtctgcaaagcaaatgtgtgatgcccggccctaatctgacatcagtttctatcaaggagttaaccaaggagaatcaggtctgactccagagctgatgcattttaaaccattgtcccatttcctaacaatccacctagttgaaatatattctccatttactcttccaggggacaatgaagggtagagaaaaattaacaatttattttcttatttaaatatgccacagagataagcgggccagatgatcaatgtcttagtcaacatctcctctcagtctggataacagctttgagaaacctccaaggctgtctggtatctacagctgagtccaaggtgggtggggctcctaccattcctcttgatggggtgggacaggtcctgcctgtcccagttacctccagctgcaggcggtgccaaccagctcaggtccagattcaccatgcagtgttaggagagaacatgttcatcctactcttgtctccacagaggggaatgaattcccagtccatgctccagaggaccaagtaccagtggcacacatttttccagtctctctctgacccttaactctctccctaccttggaggaagagtgacttgtccaaagggcatttgtggggaaataacttggcatacttagctcagccccaacccaccttgcacccccttaacttacccagcaagccttgctcctgtgagggaagcctgaggctgtttcctttgctggtgaatgagtgggtaacttcttcaattcaagagtgatgtattaacaagacaattttgccacatatccaaagccatgtcttccaatcagcgttatcggtaaggtaatgaagctgacattttgatctctccatgtgactcctcttgtgttttttaggcagttcattccaaacttgagaggggaagtaagggagggggtgttgagggtgtagaggagaaattggacaagaacggcattccctgcctggggttcccagacccctgtggctcttcaaaggcagtaatgagagtttgtgagctattttcaatatttcaaagagcctaacagaaactgcatttaaccgcgatcaaaatgcacaggccaaataaatgccaagtgtctgctttgggctggaactattcccaatcagtgaggtcacactgccctttgtccactctgatcggtgagaccgagctgtggcccttgggggacaccagaggcttgccaattaagggatggtggttccccaacccctccgcttgactgcatgagaaactttagccccttggcaaggctgcctgcttctttgaaagaggaaagtgaaatgaggtgcatttgggggatgaatgagggtagcctcaatcttagacaaagtgaataagaatgaggtcctaagaagatgccttttcccagggccaaagaacagaaccacccaagttaggaaagtgtatagctcatggcctcaactcagaccacatatgggggataaaggaaagtcgaggccataagaagttgggaggggctgaggttctgtaccaggacagcagaaaggcaggagggctgcatgcctgcttctttgagtggcacctcctcactcggccatggctttgccctcttgctgcctggaggggtggctctgaatgcagctgagaatgctaatgaacctcctccctgccccttggcagcatctcccagtgtaatttttgtagggtaggtgggatctggggagagctgatctgtaccagcagacctgaaaacacagaaatagaaatggggaaatgaatccatgtccttcttaatgagtgcagcctggtagaaacagtgccttgaaacacaagactcttgggaggaactcagagaacgggagaacatcccgcgccataacaaagttaggttgtgtcgaggaacggggaggcatttaggagtcttttcccctccccatggcagtctcagcacacagaggagagggggacctcctttctgcccaggctagggagggcttccaagggaccagacgcctgttctacctgaaactgatgagtagaacaagccccccatcattctcgtgccaagagctggctgggaaagtggacactgaggcttctcgagaggcacaatcctagccctaactctgcagatgtcctgagtgctccattctcaagatttagattcatggtgaaaggaggtggaaagctccattcagcctcaacaggccaagccatgttcttcaacatgatacaccaaagaccagtaatttgtgtttgtttagagtcagggtctcactctgtcacccaggctggagtgcgatggcatgatcactcctgggctcaagtgaatctcccacctcagcctcccgagtcaccaggattacaggaatgtaccaccagagcccagctcaggacctgtgccctgaggggtatcaggcacacgcctggctattaataaatgaatcagtacttttccctttgaccattattctaggtctttaccctactcatcagagccccagcagggagcaggtgttagtggcatatcagtttaagcaccttccaaagccagtcttaacccaaaagcttcaaactctttgccagttcttcaagaggtaccaacttctcattgacctttgtcttgtccctcctcttccattctaaagagtaaagtcactccctttgtctgactgaagcaggaaccacctattggaagaagctaggacagatgtgggaggccatagccctgccactgcagttgtaagagtgctatgttccaactgttcaggagaaaaggggtgagttccaagccaagcaaagatgcagaaaaatgcttgagaatgatttgagaagtaaaatccataagatgtggttagtgaaagggagcagagaggggtggaattccaggatgagtcccaggtttctggcttaggaagatgcatgactgtgaagatgcatgaagcaattcatagaggtgggccacaaaagtttgggagagtaaagtttctgggggtgggagagagtcatataggtgacagcaggaatgaagacttcagtgtgtggagtggggagttatgcggttctggagttcaggagcaaggtcttcattagagacctaagtatggagagtctcagcatttggacagtggcatgaaagccataggagcgaatgaaataaaggataaggcctggcgcggtggctcatgcctgtaatcccaccactttgggaggccgaggcgggcggatcatgagatcaagagatcaagaccatcctggctaacatggtgaaaccccatctctactaaaaatacaaaaaaattagctgggcatggtggcaggcgcgtgtagtcccagctactcgggaggctgaggcaggagaatggcatgaacccgggaggcagagcttgcagtgagccgagatcgtgccactgcactccagcctgggtgacagagcgacactccatctcaaaaaataaaaaaataaaaaaataaagaaataaagaataaaaagagaaggtcaaggcaaatgctggaagctccaatattaaagcaaatgttaagtgggaaggagtgatgggcagtgtcagacgctgaagagggggaggggagggaggaggatggtcagaaggtcaggaagcttggctgtggccagactgtggaaggtctaggagccggcagagatgcttggatttagtaaacaggaagtcatgtggtgccctaggctggagcacctcccccggagtgaggagggtgtaagccaggtaacaggtgctgagaaatgaattggcagacaccatctcaggaagtatggctggggaggaaaggagagagacggggtgacagccaaaagtgggtgcagtcagggaggggctgttttttagtgtattattaagacacaaagaaagtgtgtgcatgggctaatgggagggaaacagaggggagggaggagttagagaaatggggcacagggatgccaattatggcagtgacgtccctgcgtaacacagggtatggtgtcctcagcgcttccctgcacaaattcagcagcaaggctcacgcagctgtttcctttagtgtcaacttttctatgaagtaggacacaaggttgttcaagagagtgagcgggtgaggctgccacagagatgagaatggccccaggacagagcctgtggtccagagtggtcgaaagccagaggcaggacactctagggactgagttgagagggaggggcccacaagggctggagcaagagtaaagagaggcacagcattgggtaagatgaacttctaggttcaaaatctcgttgaggcccagggacactgggagggtccagatccatagaagtctacccccttgccacctacctgatcctactttctggactaatcggctcattcttactaaggtgttaatggctaacatttcccaaaatatttagttctaacagtggctttcaaaccaaagatttcagtaataacagaattttcctgaaacacaggcagacacagagcaactatctcattgctccgcatcaaaaacctccaccggccccttgcccagtctctcagcaatccttcactctgaaaaatctgccgtaatttggtgcagcaacagaaaacaaaaggaaaattgcatctttgctgctcccgaaagcagtctccagcatgttcagtttgatctgacaaccacttgacgtgtaattcattcattcattcattcattcacaatatttattgagcatccaccatgctgcaggtactgtgctacatctgcggacacagcagtgaacaaaagggccaaaccccctccttcagtggggcacagactcatcaggacaaaggggcaggagagctgcatgctctgagccaggcactctgcaagcatggacctttacaagcatgactttgaagtcaggatttttgccccattttactaatgtgaaaactgaggccaagaatgaactaggacgaaggtttgctggggtcggccttattctaaagtctgtgctcagagaatgcaccgcctagtgcttctcagactctcacaggcacaggaattgacctggggatcttgttaaaatttaggtgcagtaggtggcggatggggtccaagaggctccatttctaacaagcttcctggcaaggccttgaaccacacctcagaagccaagggtctagtgtttcccacactcatctggtcatgaaacctttgccctccccgagcatttatttactagtccctactttacttcctcaaacccaaggaatgaatgaaaccccaggaatggctgaataaatgaatgaatgccatctctgggcctcccagtgttactgtgcttcctaccttcacagccctatttgcataactggccatttgcctcagtttccctgctgagccccttgggtcctcactgggaccacagactctctaaataccccttcactgagctagggtccttctaccctgcctgctccccgccctgggtccgaggtcctgttccagccagggagaaagtgaaggctggaccctggcctcctcagccccaccctctgtagcttcctcatctcccggctggctggcctcacctcagcctgcctgcaatgcctcatcctgaaatgccagctgccccccaccaacaggcccgaagaaaacggcatttcagtgctgtgtgtctgcccttcagagagtattaaatccagaataatgggaattagtacacggaagaagttgaggataagactcccctgagtgtcctgatttctcacctaacaaatccagggctggaggaaagacttagtgattcaggagctccaagctgtcaggccaaccctcaccaacagcccttttgtgaagtgtattaagcagtttaggaatgctaatgcgtgcctttggggctggtgccttcccaggctcttccagggggctgcctaatctcatcaacacaaatctggtcagcctggtgacaacctctgggctgctgcactccctgggaacatgtccttatggcaccagcaccagggctaattgtaaaggagggacagagggaggggaaggcggtgctgcaaaggtagcccaggtgtgggctgacttgtggaggcagagcctttgctcaaagacacccaggacctgagcccttcttctagtcattcctgagtggggttaagaccagggtcatcagaaggtaagcaggaagaactcattaaagacgcagatccctgcaccctgctctcagatcctctgattcagaaaatcagaggaagacctggaaatctacatttttcttctttcttttttttttgtttttttttgagacagggtcttgctctgtgacccaggctagagtgcagtggtgcaatcatggctcactgcagccttgacctcctgggctcaagcaatcctcttgcctcagcctcctgacttgctgggactacaggcgtgtgccgccaccacacccagctaatatttttattttttgtagagacagggtattactatgctgcccaggttggtcttgaactactggcctcaagcaagtctcccaccttagtctctcagagtgctgggattacagacgtgagccactgcacctggccagaatctacatttttaactgggaaacctgtacagtggttaagcctatgggctctagaattagactaggtttaaatccaggctctccccctccctacttgtgtggtcttagcaagtaatttaatttccttaaacctcagtttcctcaactgcaaaatgacagaattcttaggagttttgtaaggggtaagggaggaatgagcagctctcactaagcatagggcctgagtgttcaacaagggacagccaaccagggactgcagctcacgcttgtaatcctggccctttgggaggctgaagggggaagattacttgaggtcaggagtgcaagactagcccgggcaacatagcaagacccccatttctacaaaaaagtttagaaaaaaaaatagccaagggtggtggcatgtgcctatagccccagctactcaggaggctgaagcaggaggatcacttgagcccatgaggtcgaggttacattgagacatgatcataccactgcactccagcctgggtgacagatcaagactctgcctataaaaaagataaaaataaaaactaagggacagcttccacaaggaagactatgatgctgataaagggggggcgggggatgcaaacttgacatctcccaagcacagcctgctgctttaagtctttgtctagctgctccctcgaagatattctacctgcaaattgctctccttcaaccgaatccctgctcacttttgaagagcctgctggcaccttctgaatgaagtcttccttcttcccctctccccctctgctgtgcttggagctcctttggcctttagtagcttataactgtccctgggggaaggaacttggttttaaaaggtatttgtgtccatgacccccaacccagggccactgcactaggtactcagtgagtgttccatgagccagtcccaatgctcctaggcagacgggagcagctaaaggccttaaaaagccaccttgatgacagaggtatggggttgaagcctggttaaagaaaaggccacggaggggagggtcctggctggggtgagggtggaggcagcaaggtgaaaggtcaggaagaggctctcacagatggcaaggctgaggatggggaggaggatgacttacaatgagagggaatcctggtttcttgggaagtagcaggactagggaaggggatggacaggaaaagaaaggaaaagacataagtggaggagattggcagagaagggagaggaaaggagagaggcggaaggaacaaaaggttgacaggcacacatggcctggacaaggtagaagatagcaggtctccccacagacagcacctggaaaggacttgctgactcagcccaagtaggtagactttctatttttcttttatttcttctttcctccctcactcccttgcttccttcctccctccctccctccccccccttctctcttcctttctttcagtcacatttttaagagaaacagggtcttctaattctgtcacccaggctggagtgtagtggcacaatcatagctcactgcagcctccaagtcctgggctcaagccatcccccggcctcagcctctcgagtagctaggactacaggcacatgccactatacccagctaattatttatttatttatttttatacagaagaggcctcactttttgtcacttaggctggtctcaaactcctggcctcaagcaatcctcccacctcggccttccaaactgctgggatgagaggcacaagccaccacacttggcctatttcctttctagatggaagttttgtgatgttctcatggaggcatgatgaacagaaccataacttatgatccatgattcatggaatgggtttcatgtacttttgactgttcactcagctgtttaccctccctgggaggccagggcaccaggtagaggacttgtggaagaaaaaggatcccctcagccccaatttgctgatgtggggctccaggcaccctcaccaaggcctgcctttgccagtagcaccctaccctcattgtgttttttcagagacctgtggctgccggccaagccagccagccatcccccttctccaaatcctccagcctcctcaatgcccttctttggtgagcaaaccttcttccagacctggaacaacccactctcactcaaccaggagcccatgcagatgaacctgcactgtcgcaagccatttcctgctcccctcttcacctgctcactcctgttgatcctgcaggtctcggcttgaacatccttctctgggagctttccttgatcccttgtgtctaaagagttgtccctcttcttttataaaaattgtggtaaaatacatataacataagtgtgcaatctgaaccacttagaagtatataatgtagtggcattaagtccattcacactgttgagctaacatcacccaccatccatccacagatctctctccatcttgcaaaactgaaagtcagtgcccattaaatgattaactccccatctctccctccccagcccctggcaaccaccattctattttctgtctctatgaatttgcctgtgctaaatacctcacacatcagtgaaagcatatggtaggtatttatttgcccttttgtaactggctcctttctttttaatttttttttggagacagactctcgctctgtcaccccaggtggaatgcagtggcgcgatctcggctcactgcagcctccacctcctgggttcaagtgattcttgtgacccagcctcccgagtagctgggactacaggtgcgcaccaacgtgcccggctgatttttgtatttttagtagagacagagttacaccatgttggccaggctggtcttgaactcctggcctgaggcgatccacctgcctaggcctcccaaagtgctgggattataggtgtgagccagcgcacctggcctgtaactggtttctttcacttagcatgatgtcctcaaggttcagccatgctgtagcaggtgtcagaatttccttgctttttaaagctgaaagattatcatatggatataccacattttgtttatccactcatctgcacatggacacatgggttgcttccgccatttggctgttgtgaataatgctgctctgagcctgtgtgtagctgcctctcttatgtacactcagcactgaaacttgcccatgtccccagtgctgctgagagctcaggcgcacagaggcactcaataactgcctgctgaaggagtaatcctgcccattctctaggtatagcatccatccattaaattgtactttaactggggccttcgggaaacacagggccttgagccagaaacctcctgtaggatgtgggggcccaggatggatggacaggaaggttctagaactcctcagagccctctatacagagagccagccctgcaagggagtgggcccatgggaccccaccatgctctctagctcatcagtgccctcctatctcaatttctacctccccaaaaacactgatggatctgactatatcaaaaggaagcatttctgtccaacgaaagctgccatatgccaaatagatggattaaagactagaagaagctatctgcaacttctaaaattaacaaagggcaacacctagactataaacaaaacttctacaaatcaaccggaagatttctaaggcaagagatccaatttttaaatgggcaaagaatataaataggtaattcagaagaaaagaagttcaaacagctaacaagcttactagacttaacagacttgctagtaatcagagaagtgtaaattaatacaacgagatggcactttacactcctaaaaatggcaaaattggacaggtggctaatattaggtactcatgaggacgtgggaagacagaaactcttgggcactcttagtggaaatgtgacctggcacaccatttccatggtgctctgaaaaacatcatggcagaacatgaaaaattaacacactaacccagggaccaaatcttccatcatatagtccagaactattctcacacagggtcccaaatgggaatgtacaaggatgttcttcagaacttttagtggtggagtaagggggagttgctgataagctagatggctatcctcaggggaacagatacgtaaaacgtgatggatgtataactcataatgcaatgaagcagttagaaaccactgactaggtacactcaatgagcatggtgagatatgcaaaatatggagttgagtaaataaagtaagaaaccagatgaaatttagacttcaatatcatttatagaaataaaaaatacatatacatacaaacaaccctacacattttataaggatccaggcttttttttttttttttttgagatggagtcttgttctatcacccaggctggagtgcagtgatgcaatctcggctcactgcaaactccacctcccaggttcaagcgattctcctgcctcagcctcctaagaagctgggattacaggtgcacaccaccacgcctggctaatttttgtatttttagtagagacggggttttgccattttgatcaggctggtctcaaactcctgacctcgtgatctgcctgcctcagcctcccaaagcgctgggattacaggcgtgagccaccgcgccctgcctggatccatgcatatttgaagacatatatcaaacacatcagaatgagtacttattgggattgggatagcttagcttcaggattggggatgaagggaggcaaactttgtaaataagagagaagttttgcacagagaggtgatcataaagtgctaatggactgagggtaggattaattcaaatgttacccacctgagacttggtggggtgcagaaaacagaaaacgtcaactgtgccttccacgtaactcaggaaaactgtccctgtaacactgtcttctttccatgttccttagaacaaaatatcgtaggagatgtgagtcccagaggttctcgaatgcagggaattttcctcttgctatagttaaaggcctcattcagatctggtaccctggacgaatgtgttagtgagagtgaagcccaagcagtcaactctccgagactgaactcacagtgctgctgcccaggggtgggtggtggttggggaaaaggctgtgaccaggatgtctgatgggctctggatggagatggcttgtttcttcccttttgagttttcaggagcagtcccacaggccactggagggtaagaatggatcaaggccaagaagctcagcaagcccaccctccttctcacccctgagacctgaaaaatagcctggcaagctgtctgcagaggtcgtgagctccccatccctggaaagccaagcagcccgagccctgggcaggatctcccactggatgggcttaaactagaaacttttttggtcttattctaatagctctggcttctctttggacgcttcttttttaaagagcttccaagtccatcattgcatagacacactgtgtattattatccccattttataggtgtgaaaatagaggcctaggaagatgaaacgattggcttctgttcacataggtggttaggggcatagccaagcctggaaggctgaattcctgactcctaggccaaacaaggcctttctcctggctgaggatctgctatgagtcagcccttctaggaatgcacatatgataaggccaggaggatagggccacataggtccctggcaggaggggatgccaacattgagatgtctgttttcgtgctaggaacattttagcattaattgaaaataaaccattaaactgtcatctctttcttactgccaagtccacacaccatcaccaagtcccacccaatcactgaactctctccattcctgaaatggcaatggaggaagcaatgaaggttggtaggtagacagattgaggctggggtagggaaagggttggggtcaggcagcaacctgaagacaaacctcccgaggcctgagtcgactctaccacacttgctcatctcagaaagggccatcaatcattctgcacaaaatgtctgcacattctctcataatatacttgtatctcaaatttcaaagtctctgctttttccctttacagttacatccgtcacactcacttactttcaatcaataaatagatgtacctacttaataatagaacttattctgttttctatttgaaaaccttgaagatggacacataattttttgaggtttatggattataattgcacttaattggtataaattagacattagcaggtaggaaggctatttgtgttgcaatataagcccttattttctgttctagatggcacaggagattctcaagtaaatttctcagagtaatttggtgctctcagtaatttaactatacatacattatttttagcatcataaaagttccttataataatgatttttcaagggtgggactgacatcccttgaaagacaaattcagtttaaaattttccaacaatacaaacacaaacaggtggaaagtaagagagtctctaggagagagactcgcccagcagagggggccatggaggtaaacccctactccatcctcggctttcctttctgtgagtggagccactgtgctagctctagggtaggcacaatgtctttctctgatggtggacttgataggagctgccctggggttcctggtttgtgccaggcatatttttcggatggtttcctggtggtggccacatgggactcccagggtctccctgaagaatgatcccttatggcaggaaaagggagcctccagcattttaggattcatgctttatgggaccaaaggctaatggagactttatgtctgctggaaatttcacaattcaggtgagaaagaaactgaccaacgttcacaaagtcctggtcaggaagatgaagatgctacaacaatgtgaggcgggtcaaggtatttccagtgccctccctcacttcccatttcctcatgtccactcagttggtgcctattcaattggttatataataaccccatcttatctcccagtctcttgttccaactcaaccaacccaaaccatcccaataaatctgactcacctctatctcatgccattctaccacaatacatctcacctcccctccatcatatcccaattgttccattctactcgaccccaactccacccaccccatcttatcccatcccaccccagtgtcttctaacacattccctccccacctcaccccccatcccagtcaatcccctgaatactgcacaccccaccctctcgatcccatccccgacatcacatctcactcaatcctatcccattccattccatcacctgtctcactctatctatcctgtgccaacacatcccaacccacctttgatcctacccaacttacaccttcctacttgagctcagtctacctcaaattaggctgtttctccaatcccaccccatcatgttccactccatctccttccctctcatctgctgtttggctaaagttcacatttgtggatgtatagtgggtcatgactatctttcatgtgacattaagctacctgagaaggccaaaggggtctcaccttctcccaaagctctaagaactaagtgtgtgtttgggtgggagagaagaaaagaagataaagaatctcatttttagaagaggagtatgaaaagacagtccaggagattgagctctctagagtccaggggaaaaataaatatgagtttcctttgtttctcttaacttacaagagtaagaaaagagctctgagagccacgccatcattttcaagtagagaaactcccacgttgcatagcccactctttgctttctgtgggtccaagggaaaaccaagcccttctcaaagcgagtgaaccctgagacagagtctttgtaagcataaagactctgaaataatcctctatttgcaggttcaccccgatgttcccctgttgttggggaagctctcacgacactgcagcagatggagaggaggggtgcaaggccatatgccacccaaggagataaatccagggagggcaatgcagtgcattctcgaggtagagggttctccctccctaccctcctggatgaagggcactgagctgggttgatgggttgagtgaggggaccaggttctaaggtgtgtgctttcagccagaggagcaaagagaaaagactccccccactgggtatagtggtgccagagagtggcagagtgtatgaattgtttctcttatatttctaagaggctggtgctgaaagcaagtagaccgtagttgtagtaatagtaatagtatctaacatgtattgaatggtaacaatgggcccagcactgtaacaagggctttccaaaaagatgggccctagggtcaggtagacttgaggtttaatcccgccttctttacctacctgctctacagccttggcccagctgcttactttctgagcctcagtatcttcaaatacaatattacagtgataattaaatggtaatgtctacaaagcatttaaccagcactcggtaaaggagagctattattattgtgcagatgggcctggggctgcctcctacttgaagatgccccttaacccgtttccagtcttcccagcccccagctgcccttgggaatgcccaacagggtggtctaaaggaaagggagccctgggctccaaacaacctgcctctgattgtctcatcagctctgactgtctcatcagcacacttactgagtgtccactatgtgctctacactgccctgcctcagttcacagtcctttagggaaatgagacagataaccacctcactaagcaagaaattccaatatgtcctgatgactctgacaacaaaggaaatgtgaggagttgtaagaacccacagtagagttccatctagatgggtgtttggggctagaaaccaagaatgactttacagcctgccccccccccacccaggagcttgtggtggaaaggaatggacaatagctgcttgaggattagaagtgtgggattcaggcctcaaaagcagcacagtataactgatgaggacagcccagtgggaagagcaaggccaaagaaggcagcctgggcagacgcttccagggacgtggtaccagctgggtccccaagaagttgaatggcaacaaggttatgagtaaaagatatggcgtcagccaggcctgcatccaaactgtggctcggctatttacttagtgcgtggataagttatgtgtcctctctgaacctgtttcttcatctatgaaatgggaataataatactgcaggcttcactgggttgctgagaggattgagttaatacatccaagtgcttaagacagtgccggtgagtactcagtgaatatgagctgttattataactcccctgggtgtccagaacagctctctgagcatggtaggtggggaaggacatggtgagggcacatagacttcctggctgattcctttggccccagcttctatttaataggcacattcgatgaggtatggcactggactcgttgcatctctggtttctaatccttccaaaaactcaggaattacttgtcctttttacagcagggagactgagccctagagaggcctgaagatcagctgggtctccagcaaggctctgcggagcaatcaggttcccttaatcctgctggcgtgatgatgagggtgaaacaggcaggtcaggcacatgaatgagggtgaagggggtgctgctgaagctgcctgctgggctctgccggagaaacccaaaccaggcagtgtccaagaccctgcaatttggtcctccagtccctggtgcatgattctaatctcaccttcaacaaagccacacactcaccagccctagatatggtgggcactctccgctgcagtcagctcattttttaaaaaccataaaccctcagcttgattgcaaatggaaattcaaattcatacacacactggtgactgagtagtgaaacgcctttccttggctcagggttggaggagagtggtatgccaagggcttattgttgcattggttctagaacctagggaactgtaaccaaacggtgatacttagttgtggggaaaggaacaggggaccagatgtctttgtcatcttattacctctgcaaaccagctggcttccttgacccccgatttagtcttatcagtccttggaaaactctccaagaaaaagaaaactgtaaaaatcatctgatcaaacagccatacatcaagcaccaattctatgccagaacctgagctggatatggggataccaagagaaataaagcaccatccctgccttcagtaagctcacattttaatatataaggcagacaaataaatgctttttaatacaattcagtttgtactacagtagaacattgagtacagtcagtgctctagtctacaagaggctgactaaaagcaagcactcagacaacatacaaagcaggggaaatttttttaatttggcatttgatttttttaaagccatgatgtaattggcacgggaaaaatcagaactttgtcagaattccatctacttaaactatctacttatagtttaatattgctttttaaaaattagttagtaagggagtggaaggcatgatagctttttcaatgctcagagctcctcaaggaaagtagctaggttcgagaataattgaggatatgaaactgacagaatttgatgaccatatgataaggaaggagttgaggataatccaaaggtttctgggctccataactgggaggctacaggaaccaccagctcacaaaggaaatacgggaggcttaagaaagaagctaataagattgctctggaagggaaatatctaagtgaagatgtccaaggatcagctggatacatgggttacctagacccagaattcccatggaccaggaagccaatagatgaatttcaggagagatgtcttggcagaagagatctgtctggaagcttcagagtgtggtagtgaaagggttgggcaaggatgagctcacccagagagtggtgaaaaggaatgggaaaaagtacaaagaattaaatgctgcaggacactatacttcagggaggggaataagtgttagtattagagactgagaaggaacacgcaagagataggagaaaaatcagtaaaacatagtgtcccagaagcccaaggaagagaaattcatccaaagtggccacagccacagagagataaaagaaaataaagataaagtacaatgtatttggcaattgaggtggtcattggtgctctcttctagagtgttccagtgtcatcctggagacagaggttgaagtaaggagtgacgggtagtagagaaaactgacatgaagacccctttgaagagaagtgactaaaagacaaaaagagatggggcagtggcttagataggtcaatagggccaagaaggcttcttggcttgttttgtggtaaagatgagcctgttcacaggtcaaagggaaatgtgttttaagaagggagggtggccaggtgcggtggatcacgcctgtaatcccagcactttgggagggcaaggtgggcagatcatgaggtcaggagttcgagaccagcctgaccaacatggagaaaccccccttctctattaaaaatacaaaattagctgggcatggtggcatgcgcctgtaatcacagctactcaggaggctgaggcaggagaatcacttgaacccgggaggcagaggttgcagcaagccgagattgcgccattgcactccagcctggacaacaaaagagtgaaactccctctcaaaaaaaaaaaaaaaaaaaagggaggatgattgatagggacagcaggtaattggtgggaagtctccagggaggctggggtggggagggggagggggagtgcaaggcaggacaaggactaaaggggttgaggggagaaggtatgggtgggtgaggagactcccctttttcaaactattttattcatttatccagtgatcactgagccgaggaagggagacggttcagtcctgagcatcttttaaattcaacagtgtgaactgaacacaaaatgaatgtgtttccccttctaatgtaccaaatcctgccgatcttctgtcaccaagtccatttccaaatctctgctgcctgcaaggccaaacagcccatctaaaggcgggaaaggcttaaaaagaaatgtactgggctgggcgcggtggctcacatctgtaagcccagcactttgggaggcagaggcaggcggatcacctgaagtcaggagctcgagaccagcctggccaacatggtgaaaccccatctctcctaaaaatacaaaaattaaccgggcgtggtgacggtcgcctgtaatcccagctactcggaagactgaggcaggagaatcgcttgaacccaggaggcggaggttgcagtgagctgagaccgcgccattgcactccagcctgggcgagaagagcaaaactccgtcttaaaaaaaatttaaaaagaaagagaagaaaagaaaagaaatgtactggaagcttgcaagccagagcagggcctgccggagaggaactaccccaagccatgaacacaaggccccctccccgcaacttctctactgagcaaggagctgcgagcaaatggatctctatagggcaggattccagcaccgctgagcggtgcaagcgccggtgagtcggcctttttctctcccctaggggcaggatatgcccaaggggcagggacaaatctagccagaaaaacaattcagtccgatgccgagacattctccaatcagctaagccagagaccggcctcgcctcaacgtacgtccgggaggcctggcgggaggtagcagcgattcccccaccgcccatgtggcaagtctgggtgaccagcagcgtcggtatgcacagcctcccagtgggtgtgggtgtgcgagaggccagagctcccaggcgcgcgcaccgcgggcgcccctctctgggtgtcggtggctatgactcttagcagaacctaagaaagtcccgtcagctaggaatgagagagccagagctggctcggggcgccctccctgaccaagaaccccaacatgccgcggttaagcggtgggcgacacggtctgcgaggacagactcacaagacgctgaaggccagagtgggccagagagctcgccactcactgacctgccagaggagaggcgcactttcccaagaaggggaactggggtggtccaggccaagccttcagaggttcaatcggtggtttcaaaacaaaacaaaacaaaacaaaaacaaaaacaaaaaagaaaacacggctccaggtcgaaggtgccctaggtctaggcctggccagcaggtgtttcggtttctcccccagtgggtgtcagcctcgcgggctaaatgaaaatgcggttccaggcatcccggtttggacccgtctccacccgggcacacggaactttctagcttgtagctagaactgagcttcggaggggtgctgtgggtaaagcgggagggcaccagtcgcggccagtagcctccacaggggaccgggttccctcgaaggttcgcgtacctcccccgcgcgctgcaagctgcagccagacacccgcgaagttccgggactctccgcacccgctagatctgccccttcccggactcggtcgtcgggagctggtcccgccgcccgcgccgccgctgccgctgccgcagccgaggcgctcggctgcagcagggcgcgggaaagggcactttggcgcggagtgagcaccgaggggaatgtggcagcgcgaagcctggcggcggcactccctcccccgcctcgggctacaacccccaccccctccttcccatccctcaacaccctccagcccccacctgcaccctcctgcaaggaatgcgcgggacccccaccgtgggcacgcgtccacctgaaccccctcctagctccgagcgccgagggaggggtagcatttgaggagggggatggcggccgcagtctgcagtcggttccagagggggcaccggtttcaattggagaaaatgggcgggggcagggaagggcagaccttgcagacgcagaaatggggagggggcgcacggttcctctccagcccccaggaccagcgtgcctggcagaatcaggagccgggggagtagggctcccggaaagtttatcgggaaaaagcctagcaccgtgggggctgggaggctggagaaactgaagccacagaccaggtgccccgcaaccccgggcggggatgtctgtctcccaggcccccacaccggccgcatccgtccaagttgcggctggggttggggcagcagtgagggtgagggtggaggtgaggacgtggctgagggtggggtgggagacggaggcagggatgagaatgagagtaggcaactgggagggtgggagattcaggcagggatagaggcggggggagggactgggaccgggtcgaggatgggtgggctcggggctcgggtggggcgcgcggcggccgctggctcctcggcgcggctggactcacccgcggcggccgagacgctgagcaacccacagcccagcaacagcagcagaggcggcggcgttggcggcggcgggcggccccagcggctcccggcgcccggcacaagcgccgaaatcccggtttcgccgcgagccctccccgcggggcagccgcagcgccccagctcccgtccccgcgagcgcggcatggcgcggccggcagcgccgagggagaggctccgctcgccgccgaggagaaaggaggtcaggagagctctggagcttttttctgctcggaaaaaatcccggtacgcgggagccctgagcttctgcggctggaatgaaccaagtgtccgcccggccggggagaggcgcgctgcgctctcggaaatgactcgctccaatcccgcttcgcggggttcgcgccggggggcgggagggggtgaattatccccggattaatcactccggagccgcttctccgccgctccaaatgctgggggtggaggcgcagctaaggataaaatattggggggcgggggttcctcttcagcgccacctccacctccagataaaccacaaattacatctaaagggttgtttatccgtgtctgttttgcaattgaccagtttcttttaagttcagtcctcctgttttcatttataacatcacccattaatacacccccctctccacacacacacacacaaacacacacacacacacacagtgacagagacacacgcactcacacacacaggcacatacacgcacacctcttccacgtttggaaattggaatcctgtctgggaaaaggtaaccaaagaaggacgcgttccccaagtcttggctcttaccagctgatcttgggtggtggctttgaacttgccatctagggccgggggcgatgcttatgagcctcattcacaatagcctcctaccccatcccaggagaggggcgtgtgtgcgtagacagaggcagggttaagaattggagggcggtggaggggggttgtgtgtggggtggggaggggggggaaccggttcatttgacccagtgcggtcccactcctaccctaagacaaaaatctcagggtggcagaggcggtccctgtgtgcacgcgagttgggggtggggagtgaggttggtggaaggacggtgcaagagttactagtacaatttatccccaaatttaaataatcggatcctacttcttcttctccccttcctcctcccagccaaggccccaaaccaagagagttcttcccaaggacgtgagctgctccccacctctccccagtagcggctgcctctaggccccaagggcttagtgtcggtccccaccccatcccccacccgactcggtcgccgtctctgtctcgtctactccaggcttctccgccagtcacgatggctccttcgctgtctacgccaaactctcggcgagagggaagagacgcttcatggggggaggctggaggaaactgggaggggcaaggtccagagaggaggcttctgctggcgcgtgcagtggaaaggcacctgcgatgggcacccccgccccctttgccgacacaccccagagaagctgtgctccgggcttagggcagcctgatttggccaaaacggagcgttggcatctgtgtggccaagggggcagtggccggcgggcggtggggcctgagaatttccggggaagggtgtggagagggactgtagggatggcgagccaggctgggggtggctggcgacccaggttggccggctgtcagcgtggccaggaatttccatccaaggaagggtgtgaagaggggctgtggagttgacgatatgaattggggggcgggggcagggctggaggagtggaggcttgtccctactccccatgaaaaacttcctccccagagccacgctttcgcagcctcctagatgccactcttcctccctccccccaccccaagttgttccggtttccctgcatgagctcatcccacagctggggagccagcccggtggccctgggcgggcgaatctcctcagaatcgcgggcctggtccccacccccaacacgcttgtatgcccgcccctcccgacgccgccttgctgggtgccaagaaccaaccgaagcagccagaactcctcagtgaaaggcctgctttatgttcccggggcagtgaggagggggcttctcccttcccattgtccagactcagcccccgaaagagagggctcagccttcccaccagccctggagaggaggaagggactgactacgccagcagtgagtggtggtggtggccttgggggctgttagctgggcttgcctgggggtgggctcctggcttctaagctccgactttacccctctcttggaggcggggttctcctccagagaaaggaactggcagagatgcccaggcctcctgtgcagcccacagctgggcagaagagagtctgggctgctctgtaattctggggctgcaggccaatgggctttctcttaccctcttctcagctccagaactttgctctgtggctgcaacgggcagatgagatttacccccagaactttcccgggcaaaaggagcgtttgtcatccttctccctgggggctgtggagggcagggcacctattttatccctgcaaaaggcccagttactcacatcctccgccattcctgctctctgatctatttgggtccacgtgctttcactgagcgcctcctgtgctcgggggccctgagcgaggctgtgctctgggccctgcagagatgcacagtgtgtggtcctgctttgggaggatgcaggccagaggtggaaacccacacgtaactgataccgtcagacagcgataatcaccatgactgaagaaccggcatgctaccgagaggcatgtcaagacagtgagcttttcctggacttgggggatcagaaggctaatttaagaaggaaagtaggatttggtctggaacctgagacatggataaagaccttgaaaagatgaagattcatttactcaacaaatatttattgagcatcattatgtgcctgggtgctgtgctagacaatgaatatacacctagtgcacagtccctgacttgatgaaggcagaaaatatgtatacaaatacacataaagttactaattaaggatgctacaaaaggaaagtttatggtgctaggagaaacaatatggggatgtgctttaaggagatggtctgagaaggcctctctgagatggcaacggtggaagatgggatctaaaattaagcaagatgctcaggaggctaaagccagaggatcatttgagcccagctgttcaaggctgcagtgagccatgatcacaccactgcactccagcctgggtgacagagccagactatctgtctatgaattaattaattaattaattaatataataatagaattaagcaaggcagccatgcaaagttggggaaagagcttttggtatagtgagcacaggcaaggctgtaaaaaggaaagggggccaggaggaggaggatggggctggatccaggtaagcaatgggagatagggagtggggcagatcacatagggtctattaggggatggcgaggagtttgcattttattcttagccagtgagaaatagaaggtgtattaatttgctaggactgctgccacaacaaagtaccatagaccctgtggcttaaaaaacagaaatgtattgcctcacaattctggaggctggaagtccaagatcaagaggtcgacacagttggttccctctgaggcttctctctctggcttgtagatggctgccttcttctccctgtgtcctcacatgtgttcccatggtacatatctgtgtccaaacttctaatcaggacaccagtcatactggattaaggcccaacccaatgacctcattttgacttaactgactttttaaagactctacctccaaataaggtcacatcctgaagtactaggggttcggacttcaacctatgaatttgggtgggggggcacacaattcattctataacaggaggagatgacttttcagatggagggaggagagagatgcttgacagtcagaaaatatatgtaaagagatatctgtttacatttattttctgtgtatagcatggctcctttagtgaaaagtagacagctctgaatatgaaaggtaggttttcatttctgggaaagagacgccaagtgatgtggcctgacatatactctaacttctctgtgaggaaagggtaagaaaggaaagggtaccacttagaagactactgcaatagtctgagccaggaaacatgggggcaaaggcagagatggggaccctggaaacatctgcagggcaatggagaggcaggagtcaaagacataacagcctacccgcatctagcctaggagagtgtgggtctcagcccagccccaagtgctggctccctgcctgcccctctcattctccctgtgagcaacaggcagtcgtgggttgaggtgtctttacaatatcacattgcaaaaaagcccaatgcagtctagtgactagccaagataagcctaatatccagataaaatcagagtttgatttagaaagaatacaaggcctgatgctctggagaactctgcctcattcaaggaggagctgtagacttgatgccctgaaattttcattctgacccaggaaaagatcaaaaagccttctgaagctgagagagagagagagagagagagagagagagagagagagtgagcaaatgggagattctagcaatgcgagggcagaaatagaggccaaggggcaggcagggctgcagagaagggctacaggacaaagatgggctcagaggaaaagcttaggatcccaaatggggcacaattttaaaatcatgagcatgatcaggccaaagcgagtatctcccaagggcgaggctatcaccatagaggtggcagtgatctgctgcccaaggagtggcgacagaggggcttcatgaggaaaaagcccagaccacaccaaggtgaggctgtgggcttctgaaaccaggagggagaagtgagaaggggcccacagcctaggccattcctctagtgctaccacatgctgtggtcaccaaattctgacattcttggtgaaaattcttcatttgtgtataaggaaaaagagttcatgccagtgacaaaacagggtgttaagccattgaaatattggagtttgttacagcagctagcaatacttttatgcaggcttgctcattttttgcatagtatcttgtgtagtcattcacttactcttcacttactctttcattcatttgttcatgccacactgagctgcatgtcagagtctgtgctaggtgttgaggaaacaaatataaagaagaataagacattcccatggcccctgtcctcagggggttgagagtttattgagaacagcgttaaacagcaaagcatgattgattactccagaagagatatagcatgtgatggaaataagaagggctcctagctcagcctatgggaaagggcaggtgagaaccagcactttctaggaagaaagcacagagtgggccagctcagggagggaggacacagtgtgtaaatctgcagcactcacagggtaccaaggaagggtgtggggtggaaatagacctctcttctgactcaacagtctctccataattgctggctttcttatttgtccctgctggtggatgggcaactctaggatggaaacctcttttctcccaagtcccagggtctgtattgtatctggcattctctctcctcagatgtctcataggagccccaccccaccccttccaccacagcctgctcagacctgggcttatccacttctagttctccaccccagcctgcctctctgctcagctccccaattcagggaacagtttccacatccacccagatcctgagccagaaacctatttatcctggactcccatcttgcccagtccccacatcaagccatcactgagccctccagattctgcctcctagacacctcccagattctaaccagagtccacaatggctatgtttcaggttacttacaacaactgagtaacaagtgcccatctctgctcttgccctattcaatgcatcttcctctctgccaccagctatctttttaaaacactcacctgatttcacagctcctctgtcttccccggactttcccctatggcctacagagtaaaatccaagctccctgctagaccctccctacaagagcccccatcatctgtccctgccagcccctctagcctcagatctccctattcccaaatccctcagctctaagccattctgacacccttgcactcttgcaatgagccatgctttctctcccctttcccctggatccttctgtgttttgttctctctgcctagaaagcttcccttctccttctgtgactagccttctcctatttgcccttcaaaattcagtccaggtgacagttcttacaagcagtatttgtcagtgccattcagagtgcctggtacatggtgaacattcagggaatttttgctggatgaatggataaacagatggatggatggatggatgaatggatggttaagtaggtgctcagtactgtttgtggaatggacccaaaggtatctcttctagacttcattatttgagttccttaaagaaatgcctccactgagttatgatttaatgttatgctgtcttcagagaaccctgatgcgagaaactgacgaacctaacagcatctctgtcttttatgaaaacagaattgcatatattgcccactatgtcactcagtgtcctttatacaaggactcatgataaattcatgcttggggttatttcctggaaacattttgtctctgcagatgaagatgtgtattttctgctgtcagaaaacaaaaactctgccacccgacgtgtttccatttttgctttagctgacaaataaggatacccagttttattgccttattacctccatgaggcctgaccagttcgggtgctggaaagtagcaactgtttctgttttccttagagtcagttcttcctttattctttgatgctgtagtttgtactttttaatctgaaagctgcctcaaatcatctcagcagtaaggtagaagaagtcttaagtgaatgcattttagtgaccaatgtcccggcatggaagctatggaaggaagggcaaaatataaagcttctagctgaagggtttcccataaagggcctcgccaggaatccttggcatacctatcactactggggtctggcagaaaaaccaaagcaggaggaaagccagctgaattctgactttgtttctacctcactggaccactactgccaccaccatattcttttattctgtcatctaggaccttccttttccctaactttaagtggagatctcataggctgccatttttacattgctaggctctcaataacaatagctagtgataatcataattacacatttctttttattgagagtttaccataagccaggcactgtgttgagaagttcacgtgcatttccatatttaaaccttcttcctaccccaaacctattgtttttacaactttgcagatgaagaaatgtcagagaagttaagtatatacaaagccacctttatcaagtagtagagtaggaattccaattcaagtgtgtcagctgccaccacccgagctcttaactgcctcctctcatgtgggcaaggaacaaggcaatagtaagggaaaaacccccaagaaatggcagagatcaccgatggtgttgccaggagagagaagccacagagtcacagctttgcttgcagaatattcaaggttccttttcaaagtcctagaaatggctggctgctctgcagccctgtcctgttgctgagacaacatgagggggaggcccattcccatgaaacatggctgcaacctcctcttcctttagctgtgatggttaattccccaagatatttgcctgggatactcctatgcatggatcctgcctctgggcagtttgacccattgagcattattcgcatgggaatgggggtccctctgggttttagggacctacaaaagcgtttgagtcctaaatattttatgattagtcccacaatacaaagaagaaaactgccacatggaaatcagtaaatatttaattaaatgcagagtataacattatgtcaacttcattaactgttggatttagtagtcataaaaatttcattgcatttggtaacaatttgtaggttggagttttctcactgcacaagatttctcgagtaggcactaagattggtgagaaatcacagcccatcacaaattaaataaattactcatggccaaaaactttcaaaagcaaaatggcaaaaatcctttcaattttcctctatagccaaaaagttatttttatggtgagaggtgggtgtgtttaaaatatgttagatgaggaacctaaaaggacctacaagagtaagcagccttaggggctatatgatgattgtaaaagagcctaggccattcccacgtttctgagttttccagcctagccatgtttgtgtcagagatgaaagccagatgagaagaggctttgactggatgggaggtaaggagaattgcctcctccttaggccttcctggttccacagagaaaagctaagaatcccagaattctaaataatgatagccaacattcactggatacatacattagccaagctattataagcactttacatgtattatttcattatcgtaaaacaagtctatgaggtcagtattttattgtctctgtttcatagatgagcaaatggagacattgaggttaaaccaacctgcccagggtaatgtaagtagtcagggggaattcaagaagttttccaagctaaaaataatttacagattaaatggtgtccatgaccattaaatgcttcactttaaactctaaaaaagacagagaccaaactcctcttcttcactactctatcttcagcacctcaaacagtgctgggcatagatacatgtgttggaggaacataactccatgttggatggaaactggaataagtcagtttatatcacactgctctgcaccaggcacttatggaatgctttgccccgcctctgtcactaggtgattctgtctagggtagacatctttttcatcatctctaatccctgtgtctttcacaattttgacccatgatggatgctcaaaaatgaacaaagcctggaaaggcgtaagtgattatgtgaattcgtttctccatcacagaacaacttccccagtacaacacaattctccctctctacacaaaacacaaaagctgctattcagaaactccaaaggcatgcatttcagtgtaatcaacaagcaaacaactgtataacacgtttatctgtcagttgttgttcaagggactttccatgtgttaagcaattggttagtaatagaacatctgtagtaattctacaaagcaagtattcttcattatcatcccattttacagactaagaaatcaaatgttgtgggctgaattatatgctgcaatcctaaaccaaatacctcagatgtgactgtatttggagatgagtcctttaaagaggtagctaagattaaaaaaaagaaaaaagccattagggtgtgtcctaatctaatatgactggtgtcctttaaaggagtgattaggacagggacacatatacagggaagaccatgtgaggacatagggagaacacagccaagtgcaagccagcgagagagacttcagagtgaaactaacaatgccaacatcttggtcttggccttctaacctctagaatggcaaggaaataaaattctgttgtttaagccacacagtctgtggacttcgttatggtagccctaccaaactaatacaccaaggcacagagtaacttgcctaagcttacattgccagaaaacgtgaactcagaatctgaacccagggactctggttcccgagaatatgtatttaatgataagaaatgttctctgtgctgtccaatatggtagccactagccatatgtggctactgagcacataatatgtggctaatgcaaatgaggagctgaatttttcatttaatttatataaaaataaagttaaaattaaaacaaccccatgtggctagtggctaccatatggacatagctttatactatttctaagtacatcacttaagatttttgcagaattttctagaaatctcgtctgtgcactctaaaaacatgctctatctttgttccgtatccctgctgtatttgattttttttttttttttttttgcagtcctttctgatttagcccccgttgcctggtctcctgctgagggggagagggaacaggaagagtgagtgagctggctaacttccagaatcctggggcctgggcagtgcagggtcgttggcgttctgctctaagcttaaggtgttagccaaccaaatgccaagcagcacaaacactgagtgacattttcagaactattaatatttcatcagaaatgatcacttttcctttaaatacactattttaaaaggttttctacattcttaactataattttattcagtctaggccctcagaattttccccaaaggaacacatcttcaattttgtaatgaaaatcaaaggagaatgaagctcagatttcaaaatttagagtaaacatttccaggaactcagcccctctgtaaagagcaaggttgcgtattgggcacctactgtataccaggcactttacatacagtataccattaattcatccaacacatattttttgagtgcctactatgtgccagaaacatgatcctcataatttattaacaccattttacagaaaaggaattcctctcatccttctcaaatttttctcctcaaagaagtcggcctggaccaccatggaatattgcctcccctc

SEQ ID NO: 1239 - DNA, 55383 bp, Homo sapiens
aaatacaagggaataaaattaccaaatccatactgagggcatgtaaatttcatgataaggctcataaaagtaaaaagaggcaaaaagcatttgaaactggaaaaggctgacaaatctcatggatatatataaaaatggtcatatgggcacatttaaaattaggtagaaaaaaaagattgcaatacagaaaacaactttttataagcaccttaaccactgaaattttcatctaacaccattgctatagtcccatcaaacagcaacaacaaaaatgcattttctaaatcaggagtcaacattttctgtaaggaaccatatggtaaatactttaggttttgcaagtcacatagtctctgttaaaactactcacttctgcagccataagaaagcagccatagacaatgtgtaaagaaatgaatgtggctgtgttccaataaaactttatttacaaaacaggaagcagaccatagtttttccgattcttattctagtttattatatttaacatgattcaaacattgctaaagtttgtgatttactctctctcatctcaaaacatccacactacctttcggagatctcctccagaacagtattccattgctagaagaggcacatcatgaatcaaaatattcaattcttcaggaacatcacaggcctttacaacattggcatggttcaacctaataagaaagaaaaacattacaataaaaaaaattatttccaataaaaagggactggatttgaaatgctacttaattgtgggtggatgaacagagggggaaagatcagtattatttataatattctaatttctgatttgtataattaaaaattagtaattttttaaaagaaaacacacataaaaataccatcactattactactattacatttctaagtgccaagcagtaaacattttaaatatattaactcagttacttgtcacaataatcctattataggtagatttattaatactttcaccacacaggagaaaattgaagcacaaattggctaagtaacaagatcacacagtgagtaagtcaaatctggcgttctaggctgggtgtagttgtaactgtaatcccaacaatttgggaggctgaggtgggaggattgcttgaggccaggagttcgagatcagcatgggtaacacagtgagacctcatctctacaaaaaattaaaaattagccgggtgtggtggcgcatgcctatagtcccagctactccagaggctgaggtgggaggactgcttgagcccaggagttcaagtcaagcctgggtaacatagcaagaccacatctcttttaaaaaaaaaaagaaaaaaagaaaaagaagcaaacagaatttccatgtacatgtaggacctgataatttatactattaagctttcctggtgattctgccacataaccaagtttgagaatcaaaatggaattaagcacagatattagagtcagaaagtatttatttcaaatccacactttaccaaccaccagctatgtgattctataagcttcaacttcctcatttgcaaaataatacctaaatataagattgctgtgataactggaagaatgatctgtaaagtacttagcacactacctgtggaagttttaaaatatgtctacttctctttttaagagcttaactctcctccccttgaatgtaggctgtacttagtgactcactgtaacaaacagaatgtggtggaaaaggatggagtctcacttccaagtaaagatcataaaagatacgtcggttttcatcttgctcgctcgttcactctctctctctctctctctctctcagatcactcactctttctgaggaaaagatctttctggggaaagctagcttccatgtcatgaaaacattcaagcttccccatgaagaggcccacatggcgaagaactgatgcttttggccaacattcatataagtgagcatggaagcagatactccagccccagtcaagcctttggattactgcagctccgaccaatatcctgagatgtctcaggaaagactctaagctagaatcacccagctaagccactcccaaattcctaagtcacagaaactataagatactaaatgtttgctattttaagccactaaatgttggggtaatttattttttattatttatttatttatttagagacggagtcgcccaggctggagtgcagtggtatgatctcagcttaccgcaacctccgcctcccgggttcaagcaattctcctccctcggcctcccaagtagctgggattacaggcacccgccaccacacctggctaatttttgtatttttagtagagatggggttttgccatgttgaccgggctggtctcaaactcctgacctcaggtaatccatccgccttggcctcccaaagtgctgggattataggtgtgagccaccacgcccggccctagctgacttttgttaactgaaatgaaatagttttttgattgtggtaaaacacacatagcataaaatttaccaccttaaccatttttaagtgtacagtttagtggcatcaagatgctttccttttttttcagacagggtcttgctcttgtcacccaggctggagtacagtggtatgatctcagctcactgtagccttgacctcctgggctcaagcaatcttcccacctcagcctcccaagtaactgggactacgggcatgcaccaccacacatagctagtttttatattttttgtagagatggggttttgccatgttgcccaggctggtctcgaactcctgagctcaagcaatccacccacctcagcctctcaaagtgttggaattacagtgtgagccaacatgcccagcctggcatcaaatactttcacaatgttttgctactatcactatactgcacaaaactgtttaattctgcaaagctgaaactccgcacctattaaaaattattctctatttgctggtcccttcaccctctggcaaacaccattctactttctttcactgtgagtttgactactctaggtaccacacataagtggaatgacacagtatttgtctttttgtgactggcttatttcatttagcataatgtccacaagattcatccatgctgtggcatgtgtcagagtttcattcctttttaaggctgcatgatattccgtttcatgaatataccacattttgtttatacatgtctctgctggtagatactgggttgcttttacctttcagctattgtgaataataatgttatgaatatgagtgtacaaattactctttaagtccctgctttcaattcatttttgtatatacccagaaatggaattgctggatcatatggtaattctatttttaattttttaggaatcaccgtactgttttccgtaacagttgcacaattttacattcccaccaacagtgtgtaagtgtcctagctgattttaactaaaccttcttaatcttaatgtgatattattatttgaaatagaatatatttaatgagagaaaaaaatatatgttcccaaaaagatcctgagaagagtggattcctggcctctttccccatgatgacatctggttgggctgtagaaccagggaaatgtaagtcaaggaatacacttacttcttcataatctggatttcatggcaccatcgttctctgtttttggtacttagctctaggcgacaagacttaattgctattttgagatcaagttcctgccaaaatagaaaatcaacagaaaaaaaaaattaggttcttgtgaagatttatttgctaccaaagaaataacttaagacaacaaaactttttagctttactaattaaatatatttatccacagctctcttgaggcaatgctttttaaaaagataaaccatgagactattacaccaatgctttaaaactgaccttcaaacacacaacagcatacaagggaaaagtgcctgaaactgattttataacaggtcttttcagaactctctctcatatataatgttagaaaaaaaaagatcctgtctcctcagcaaacccctttcagagcttaatcaagacaactaatatgtgccccagcttctagcataactaaaatgaagaaggtaattcagggcttcctggactccaaacagcaagagaaagttttaatataaccaagcctaaagcaaaaaactccaatcctaatgtatgcatttcaaatgacatgaagaaaaaaaatcctaccaatgagtgtacttctgcttccatagctacataatgaacctaacatctcttgcctgtgactagtaatttagccaattctgactgaaattaaacccattctgatgcatattacaggaaatagccagaccccatcatattctggcaacattaataatgcagctcagaaatagcagtcagggctaaacaggctacactatgtttctgatatcacaaggagagttcaaaagaatttccaacatatgtaatctctgacacaaaccagagttgtaataaaggctgtgtatgaatacagagagaagagcccaggggccaggacagaaaaaatatattataggtggggaagcaagacatagcttggatagggtagtgtgaattggagggtgagaggaaaaaagaagctagagataagatgatacctggtgcatagagaagaaggaaactaggatagactgcatgctagcctacccacagttctcactcccttcaatcttccttttgttatgagcaggtgaccagttatatctatgtcccatgcaggcctttaccaccatggaaatgagaatcaggcacaaccatgaacaacactgagccctgaatgctcatgttaatggagcaataagttatctatttcaaaaatcccactttgtaagatccttcaactccttaatttatatttcatcaactctgtgaaattctaccttttcacaaagaatattctatgggaagtttatagatgtacaacaacaacaaaaaagtcggaatattctggagatagggttatggctgtacaacaacgtcaatgtacttaatgccacctaactgtacacttaaaaataaagtgataaatgttgtgttatgtatactttaccataataaaacaaaaagtgattaattcatccatccccacccagggaccaagaaaagaagtcacaaaagctgccagcatgcatcctttttccttatgaccaggcggataggcaggcttaggtaacacaggcaacatgccactggaagcacttggctcccacttttttttttttttagtgtgttatgttccctctgatggtgagaattattaaatttactacttatcctgctatcacaggacttaatgccttagtccttcaccttccattctctttctccaagattttctcctatgccctatctagaaacctggttcacaaaacttcctcagttctaacagtttcagttgtcattctaattaccctaaatatgcctattttcccaaggtagactcctatctcccctttctcccaccccaaattacgagctttctcactacacccatgttcctttagataacaaattattacttttcctcttgaattaacttctctattcacaagccaagcccaggcattttagtaagatcttacctgttcatcttgtcccatatgttgttccactcaaatttatcctttacaaaaccattttcctagaacaacactttttatcttgacatttccttaaggccaattaatgaggagcattatgatcatagcagcaacaacaacaaagtagcagcaggtgctaacagttgagggctttcatgggtcaggtaccgtatttagctttacacacattactattttatttaactctcaaatccatgatgcatgtaattattatactatacttactttacaggcaacaaaacaaagcctatattacaggaattattagtccagggtctatttacctaaaatgtcctttaggaaggcacgaacctctcaaatggcaatgcatggttgtgtgaatgtgcatctgtgcatttttctggggaaagggttcacagcttttatcggtatatcaaaaaatacatgtcccaggcctggtgccgtggctcacgcctataatctctgcactttgggagcctgagacaggtggatcgcctgaggtcaggagttcgagaccagcctggccaacatggtgaaaccccgtctctactaaaaatacaaaaaaattagccaggcacggtggcgggcgcctgtaatcccagctactcaggaggctgtggcaggagaatcgcttgaactcgggaggaggaggctgcagtgagccgagatcgcgccctgcattccagcctgggcgacagagtgagactccgtctcaaaaacaaaaacaaacaaacaagacccaaatatgattttttaactgctactacaatggttaaacattctctattaaatcaaagtaaaattcttgagtctgatgttaactgtcctccacctactagagcgccccccatctccatctactaatatagcctttcgtttgaagccatgctctgcaccaactcaccctcatactgtcccgacctggaatacatccccaattccaaagcccatccatgcttccaaaggcttaactctggacccatcatgaagccttccttgtctactccagtccccactgatatcatatggcctccaagcgcgcgcgcgcgcgcgcacacacacacacacacacacacacacacacacggacgcacacattcccaaaggcagtccccttcagccctcttctcacacattcgtgctcctacatacacactgtgacgtgcatctgcctcacacaccctgacactccacattcacagagacacacacgcactgtcacactcactaaacacctggtcacagcctgacagtcatacccaagttccccgcaacagctctatctatgcccagtacctcaaatacaactttggacacacaggcatagtatctttctctctaatacacacacacaagcccactggcccccaaatactgcccaaggtcccaccaaccatctatcccacactgtcagccctgtgttccacagacgctcaaacccaccgccgctccaacccaccgccgctccctctcacgccccgcctcacccgatgctggtacagacagacgttcccgaagccgccggtgcccagccgctcccgcatctcccagggcccgcccgcgcccggccgcagccccgggggccgctccatggggcgggagggcaagcggcctcaggttccacagttgttccaaggccggttccgggccgccgatgctcgcgcgtctttgttctcgcgagaatgaatgcgtcacttccggtaaccgctgcgagaaggcccttccctaagttctcccagggcgctgccagagccctgccggctaagggatggggaaacaaacaggtactcggtccgctctttaagtcccctacgtattttccgggagggctgaacggaaccacaatgtttttctagtcttggaaaacataagatctctccaaaccccacattcccgtcaaatccacttttcaaagcagcccagtctctcctgtatttttttctttttaattaagatggggtctcgctccgttgcccaggctggagtgcaatggcacgatcacggctcactgcagcctcgacctcccggaattaagcgatcttctcacctcccgagtagctgggattgcaggcgcgcaccacctcgcttggctaattttttattttttgtagagacatggtcttgctacgttgcccaggctggtcccgaactcctggtctcaagtagtcctcccaccttggcatcccagagtgctgggattatagacatgagccaccgcgtccagcaattagtcttttctaaacttcatattgtctctactcctatctacacttcacctttcttcagatccctgccatctatcctccaactccaccaccagctgatccggcacgctaaagaccaccaatgatttaaaggctgcgaaatcgttaaaatactacgctagcaggcccactaatgaattagccttcttgttcactgacttcccaatacacctgctccaggatatcccctgtcatcccaaatgactcaagaatgtgacgctattccggagtgaagagtgtttctcgggatttcgcgagcttttttcctagatgcctcacagagcttgctgtccggcagtccagttatgggtttgccagcacagtagttcattgtgagaagtgtttctaatgggtgctacagggctgcagaggcaagctttgggaatgctgttggtgcagcaagtgcttccgggtggcggattgccatagcataggggaaacaactcctggtcttccatttaagagggtcataccttcactgtacctgggggatctcaatactccaagtaaaggaatcagcatggaatcaaattattgataaatgtgatgctgcaaccagaatgttgagcactgcatgatacagacgaagtcgatgttgtaggtcattagtaacatgtggtatgggaggttctggtttctgtaagtgcatggtttccatggacttggagatgatgatgcctctgaggacatgtcatttagagctgggcagaccgcacagagaattgtggtacagattgttgtaacagtatgaagccctctcatttgctgtatgtacagcatggccagtgctaatgtgctcaatttccgtaggtggggctgtaatctcgtaattcccagtcaaaagaggtaggaagggatgctgaggacccagggatactgatgattgggctgacccagaagtggccatctttgtggaaaccaggttggttcccttggttaactttttaaatgcccccattcccagggccatgagtaatttgagttgttttttgttgttgttgttgttattgtttgagatggagtttcactcttgtcacccaggctggagtgcaatggtgtgatctcagctcactgcaacctccacctccagggttcaagcaattctactgcctcagcctcccgagtagctggcattacaggcgcatgcaaccacgcccagctaattttttgcatttttagtagagacggggtttcaccgtgttggctaggctggtctcaaactcctgatctcaggtcatctgcctgcctcagcctcccaaagtgctgcaatcacaggcatgagccacctggcctgttttttaaaaagcctaagcctgttgaccccaggctccacaatcttcaattttccgagtctcagtttttttttcatgagtaaaatagaggtaatacctacctcacagagattttgtgaagattaaatgaaacagtgtctggaccataagtgcccaatataaaggtaaaaatatttttctttttgcgcctaatatgtagcattctctttgctccttctctatgtaaatgttagatcactattttcaagcactccttaaatactgatatttctcaggtaatcatcttcagctcaggactgtatttaccctatcttaatttcacctatggcctataccctgatgatccccaaagccctgtaaccaacccaggtactgatgagtttagaactgcccagcagcacaacagacacatattagatatatcaagcacctaaaacaatatccaaaggagaattatcttttttttcttaaatctgtcccttctattccccattaaactgtaatctctgggacaacagggaccatattgggacatgactatggtcctggagcttagaaaaatgcctggcacataggagttaaatatccgaaggactaaatgggctcttatctatgaataagatgaatgcttaagagaaaaatagcaaaagccttggatcccttttccactttgggttgttcagggagaaactgccctgtgtgattttggagtaacagctgggcctaaagctctagcccctgctattacacatactacttcatttcaacggtcacaggcaacatgaacacaagacacttctcaaccatggaaaaacatctggatttcatttggtagtttaaaggtttttgaaaatgttgatatacacaagctgtacttggagctggataacagacataggagctggatgacagacatacttttattcttttatttttgagatggagtttcactgtcacccaggctggagtgcaatggagcgatcttggctcactgcaacctccacctcccaggctcaagcaattctcctgcctcagcctcctgagtagctgggattacaagtgcctggcaccacgcccagctaatttttgtagctttagtaaagacggggtttcaccatgttggccaggctggtctcaaactcctcacctcaggtgatccacctgcctcggcttcccaaagtactgggattacaggcgtgagccactgcgcccggccttaacataggattttcatcctagaatgacttttccccaaaaagattcaatcttaggcctcttgctgtaggcaagttccatgggactgcacaaaagaggcagggaaacagtccccatgggagattgtagtttctttaaaaataggcttctaggccaggaatggtgtctcatgcttgtaatcccagcaggttaagaagccaaggcagaggatcccttgagcctaggcattacagaccagcctgggcaacacagggagaccctcctgtctctataaaaaatcaaaaaagtttgccaggcatggtagcatgcgcctgtggtcccagctactcatgaggctgaggtgggaggaactctagagcccaggaggttgaggctacagtgagccacagttatgccactgcaatcctgcttgggtgacagagcgagactttgtctcaaaaaaaattcttttaattaaaaaaaaaaaaaagctttactacttcctgtggagttcataaaaagttcttccctttgttttagtcatccagagtaaagtcatagggctcaaagtctttccggaagcggcgagccagggtctcctcgtcttccttgctgatctgacactgcctccagtcagacttatcaggaacattaaggatggcttcactggccaggacctccctgcagaaatagcacaaagaagtcaaaatggaaactatcagcctgagctctcctcaacatcacccaaaggaggtatgcaaatttctctgactttgctctcctgccctgagtgccatctctgccatactattgatcaaaatcatacccgttttaaatgaccagctcaggtactatatatttcctgatccttcaaaccccacttgcttctccctctcttaaaaaacttggaactatattattggtacttagagaagcaacaccacatagaaaaagggcaggccctggtgtgagaaagatcagagactggatcccatttccagctttgccacttgctatctatgatctagacagatgatttcatctctgagtcttgatttcctcacctatgaaatgcaaataagaacacccaccatacagggtttttgtgaggtacagagataacacagtcaaagtgccatattagctgtgattacaacctgccttaaactgtagttttgtcacctcaactagacatgagtttgcagagtcaggagcctagtcatacccactctgatttaaaattcctctgcctctccttctaggggactcaggcccacgtaacagcagcacaagcccaatgtcaacaaaacaactatcttggctcttaggactaaagaataactacatacagacacactcacacacaagctgccttctaatcgccattgctttatatttttatttttacttattttgatatattagaaataattctattacacatttatatggttcattttccactttgaagttacagtaaatagaagagttagaaacaaatcatgaattctctataagtcaaagaacctaagctccctgggcaaactttgagcctatttcaaatataaaaggaaaatagaactacctttcttgtacagctgaaaaaaatatgccatttcaaatattttgttaactataaaatgctatataactataaattagtatcttgataattactcaatattgaaaatacatcataagcacaaaaccattcagagaatcttctttttgtgtgctttatacgcctatgtgtatctgcaatcgtgtgcttatgttgtcaatgttcataaccgcatctgttgctgaggcaacaacgaaaacatcacgtcagatgtctgaatctcgtagcacacttgttcccatttatctttttgaaaaatgtagacaactacatttactggacttatctaagggggcaatctcttggaggctttctgaattagtccaagacaggttcaaggctcactcaaagcccatttttaactaggggagaaaaaacagctgcaaatcacagacaccagcatcagatactctgttctacacattttccactccccttcaaactgtatcttcttgccagcaacttcccatcttcaatctttgcttaagttatgttactccctctatggttttgcagtcatgttttgcctgatacgaggaacagaactgaagcctcctctaggcctttaccatactgtagaacactgaggttaagacctcaagttttgaggtccaacaggcctgggtttgaacctaccactgtgtgactaggacaagctacctaagctctctacagcctgctatccagtggggtaaccattagccaggtatggctatttaaatttaaattctaattaattaaataaaatcaaaaatttagttcctcagtcacattagccacatttcagcactcagtggccacaagtggctagtcacaactgtattggacagtgcagatatttgagcatttccatcgttgtgaaaagtctaccgggcactgctctagagcctcattttccacactggtaaatcgggatgacagtacctaccttacagagttatgaagattaaatgagtcatgtatgtgtaaagttcttggtacagttcttggcacagagtatgtgctcaattaaagttccctagcacttctggctagaatgccctcacctcaatctttgccctctaaatatgcctctcaggttcaactttgccactttcatgaaggctttcaccaactagaaatgagctgtcccttttctgaatttctacagcacattgttctccaaaactctgtcatggtactcttcacattctacattacattactgtcatatatgtaaacatctgccctaagaccatgggtcctctggggcaaggactgtttacaatttagctttttatcaattgtcccatgtagcccaccactctgttcatagcaggtctagtgaaaatacattgaaaagaagaaaaacataccttccaaactgcaaaggaaaattctttttaattctgtggaaaagcttttctcctgtgtcaagttcaacataaaaatatgctgctcctggctgtgcaatctaaagtaaacagagttgtatgaggatgtccaataatgctttaaaaatctataatctgagttcatctctaggcaaataattcagtctaaatgcacaagaaaaaaagatatgtatgttgctatagatcccaagccacttagtggaactagggcttaaaaagtctaactggaagatactaacaatatcctcccagtggcgtctatccttctaagttcctaccttaggaaattctaatttcttgctcttcccaggaaagcactaaactttggagtaatgccctgttcatctccagtctagtcaatacccagtgctctagttccaaattgtccactgcctcttttttttttttttttttttagagacagggtcttgcgatgttgcccaggctgaagtacagtggtgcaatcatacctcactgcatcctcaaactcctaggcttaagtgatcctcctgactctcagcctcctgagtagctaagactacaggcacatgccaccatgccaagcttatttttttattttttgtagagacaaggtgtctcactttgttgcccaggctggtatcaaactcctggcttcaagtgctcctcccgcctcagcctcccaaagtgttggattacaggtgtgagctaccatgcccaacccattgcctatttaataacatttttggaatgccttgatagctcaacatgtcaaaaaccttaggctcaacatgtcaaaaaccagatcttgccaggcgtgggtggctcatgcctgtaataccttcgggaggccaaggcaggcagatcacaaggtcaggagttcgagaccagcctggccaatatggtgaaaccccgtctcgactaaaaatacaaaaagtagccaggtatggtggcgcatgcctgtagtcccagctactggggaggctgaggcaggagaatcacttgaacccggaaggcggaggttgcagtgagccaagatcatgccactgcactccaacctaggcaacagagcaagactctgtctcaaacaaacaaacaaacaacaaacaacaacaaaaaaaacagatatttactcttccctgaatatcaccatcccctgtttcacctgcttgatgtcagagtgctctgggatttccaacagctctatctgctgctcctgtgcctgggtaatgaaggcatctttaatgtcatcagtagtagagcagctgattgggacaggaatgacctgggggttggggagacaggagaaattccttgtgcaggtcccagagaagttgtgcctgcacagtctctgagaagtagcaaatccatcacaggggtggagaaacacccctcagcacagaatatcctcaggccagacaagcctgtgtcagcctgtctgtaaggacttaaacttatgagatagcctgacacatgtgggagccattctctgatgcaggaaaggcttaagagagatatctccgtcacaagcctttgccatctccgatattatatatgtggcagagttaggcccatttgaaaacttaacaaatgtgccaaaaagaaaaccaccacaactacaaatgatttacaatctgattttctgagctgctagccccatgcaggctttgagactatttcctaccactaagctttccctcatgctgggcctccacacaaaatactcactttcttccaaattcttatccagcaagccccacatcttccttggaacttcctcaactacccattccttttctaaacaaggaacttactatctatgctgtttacatgtactgaccacacacttccctgtgaagtctctggggttaccaccagatactctttaaaaactttttaaatgaatgttatttaaatattaatataaaaatattaaatattttacatattaaagctaaactttatataattttttttttaaagatggagtctcgctctgttgcccaggctggagtgcagtggcacaatctcggctcactgcaacctctgcctcccaggttcaagctattctcctgtctcagcctcccgagtagctgggattacaggcatgcaccaccacgcccagctaatttttttgtacttttagtagagacagggtttcaccgtgttgcccaggctggtcttgaactcctgagctcaggcaatccaaccgcttcggcctcccaaagtgctaggattacaggcgtgagccacctcgcccagcctatttaaatacttatttaccaatatcaaagtccccatagcgcccttccaagtttctatgaacagaccacctacctgtagctggaggtgatggctcttataatttctctcaaatacaacacaccatttccctcgactcttaaagaaccgtctcagagtggccttatacttctccacctcttctaccacctctgctgaaagctccaccactgactggtagtgtccaataggcaggatgaggacatggtcatcagataagcctcctttggccagggcaaggtagcactgaagaagcagcacacagaattgagacatcaatacagcatgtaggattctccagggagaaaaacctatacaaaaagtgagcctgagggtgtaggcgaaaagtacttgaggttattaataaaaattctttcttgaaaaaatctgattttagagattgtagcaacaatgttctcaggtatccgctgaagagtgagattcggcatgaaaatttctatgcaagtagcaaatgaactaggagcaaatgaattgggagaggcacacaagcaggcttttggcttcaaacacactgagctgagggagaccagaacaaatcgctgggttttccctcccatgctccaaacttgaaaacagtttttcagtttttatcaccctcaaccacaaaaagatacaacttctgatttcaaaatgaccactttcggctgggatagtggctcacgcttgtaatcccaaaactttgagaggccgaggcaggtggaccgcctgaggtcagaagttccagactaggctgaccaatatggtgaaacctcatttctactaaaaatacaaaaattagccaggcctgtgatggcatgtgcctgtagtcccagctactcgggaggctgagacaggagaattgcttgaacccgggaggcagaggttgcagtgagccgagatcgcgccactacactccagcctgggtgacagagcgagactccgtctccaaaaaaaaaaaaaaaaaaaaaatgacccctttctgcctccccagtaactttcattcccacccccacccccgaatatactccttgggctcacaaaaaaagctaagatggcatgattagcatctaatgttcctaagccttaagctgctgactaaattctacaaaacaaaagcaaacatacaacctaatggggtagaaggaaagtaaaacctcaaactcagatgcatccaaagaggcagaaaagaatgatttccaacaatggatgtcagcctttaatggcaactaaaaatatttctgtaaaaaccaaaacatgcaagaatggtctaccactcagatattctctgatgggaagatgccatgagtgagcacagaagggcccaatgagtaccagtacaggcaaatatagatacgttagaaaacaattatccagaccgggtgcgttggctcatgactgtaatcccagcactttgggaggccaaggcaaatggatcgcgaggtcaggagttcaagaccagcctggccaacaaggtgaaaccccgtctctactaaaaatacaaaaattagctgggcatggtggcacgtgcctataatcccagctacttgggagactgaagcaggtgaattgcttgaacctggaaggcggaggttacagtgagccgagatcgtgccactgcactccagcctgggcgacagaacaagactgtctcaggaaaaaaaataaaaaattattccaactatgctcttagtgtggtgggctcaaagttaaggctgaaggaaggaatcacttctcatctataataagaaagtccaacagaatgacaggatatgtattggaaagatactaaagcatgattgtccttgatttgtttggcagagaggactgagcatattgacaaagttaattttccagatgactaaagttgatgaaaacctcacaggcactaaaaacttttttttatttgtataataaccactttatattgtatttgtttaaaaggttactctagaagcctgagtcgtctagctatttttgtcagaaggtcactgccataaacatcagcttctctattatgatgtgcattctttaggtaatgatgtctaaactaaagagctcctctgcaccatctctaatcctgtacttgcaatttttgtgaatagtttcacgcttgcctaatctcctctctctttcaaactctcaccttctaatctgttctatactagaattatctctaaccatgtgtaaataggacctggataaatggttctccccgtaagtaaaatgcattgattttgcaataattattttacactctcagcagcccttccccctttttactaatctgtggctatggaccatcagcacaattctatgtactacctttgaggaaggcacgacaaagagaaagccagggaaaaaatttaaaaaacaaaaaaaggcaatcaaaaagaataattgcagggaggagatcccaaactcttccacagacacccaaaggtcattacaggtttgtaagaggtttctacctaaggacagtgtagactctaggctgaaatactcatgtggcctacttgggatgttgggttgggccacaaacaagacctttttcccctctagtttcaggcctagatgagaagaaaacaggtttccttgattgttgcccaggcccacaccctgagttagagtaacctggacaatagaaagatgaatggaaaagaaaagtcacttctcactgaggcctagagcagcactgagctatgtcacacattccaaatctcttatctcctgcgtgtgatcttgaacctattgaagcttcccaaacagaaggcaattcaaagcctaacttactatacaaattgtgtgggagagaaaaatagcataaactaatccaaagacgaaaaaagatgcaaaagagatcatccaaaaagggcactgctataaaagctagagcttctcaagtttgctcttattccactgaagacttcatccacaggttctatggctcagttgtgtcaccggccttgacttcattagtgctccccctagagacaggagtgtgccactaattaagccttttttttttttttttttttttttttttgtgacagagtcttgctctgtcccccaggctggagtgcagtggcgcgatcttggcctgcaacctccacctcccaggttcaagcaattctctgcctcagcctcctgagtagctgggattgcaggcgcccgccaccacgcccagctaatttttgtattttcagtagagacagggtttcaccttcttggccaggctggtcttgaactcctgacctcgtgatccacctgcctcagcttcccaaagtgctgggattacagccgtgagcaggcgtgagccactgcacccggccaagacattttttaaaatgtaaaagactgagactcttcaggtggaaacaacacaggcagaagtgtaactccttaaagtgtaagatgaaattgagactctagtcagtctacaggaaggaagacacaaaaaacggtcctcagattgttaggataagttgaaaggatcaaccccagaaaccaaaagtagaacaaatcaatgagaaatggatgaaggcacctgtcttcagaagcactacacacttaaggaattgtcttagtccatcttgtgttgctataatagaataccacagactataatttatttgaatagaaatctatttggcttgtggttctgtagactgggaagtcgaagtgcatagcactggcacctggcaatggccttcgtgctgcatcatcccatggcagaagggcaagtgagggtgagagtaaagaagcaaaaggggacctgaactcactttaacaaagccactctcatgataacccactactgtgataacattaatccattcatgaaggcagagtccttatgaccaaatcacctcttattaggccccacctcccaaaactgtcacaaaacaaaaatgacttataaatattttcctcaggaatcttggggaacatccaattctagtcactggtgactatagtgttaaaaattaagttttcttcattctaaatgaatgaaaaagaacaatggtctacagaaaacccagggaaatcagagtcaaacactggtattatttaatgtctaatccagccctacccaagcaaaagtatctggggaaatgtgaaatagaatgactttcccatgagacacacacattcaagctttccaccacctgaataaaatcatactcaagaccatcccgttctcatagtctgattcaatgcttaccaaacaaccatatcatcatcatcttgggttcctagatactcacaccaggagtgtgaatatgggtattcctgtcattagtaagctacaccctccactactaagcaaaactgaaattttatctttgatgtgatcagttagtgtgaatcagcttccagcattacataattccagataaaaattcataggccgggggtggtggctcacgcctgtaatcccagcactttgggaggctgaggcgggcagatcacctgaggtcgggagtttgagaccagcctggccagcagggtgaaaccctgtctctactaaaaatataaaaattagccagatgtgatggcaggtgcctgtaatcccagctacttgggaagcttaggcaggagaatcacttgaacccgggaggcagaggttgcagtgaactgagatcacgccattgcactccaacctgggcaacagagcgagactccatctcaaaaaaaaaaaaaaaaaaatttcataaggctctagtttctgaatctgaagctataaaaagaatatcaacatttttaacccaatacaggtatataagcaacagaagactgcctttttaggacaaagaaaatcactttaaatggtaattagcaaaaggaactcatcactctcaattagacgggctaaaaaatacagagagtccaagaagtatataaaagcatcacccctagagaaccatacctatttatgagagaggaaaagagagctatcttgtaaaactggctattgctataacaaatgttgacagggatgtggaaaagcagaaaccttcatacactgctggtgggaatataagatggtgcagtcattttggaaaacagtttagcagtttcttaaaagttaaacataaatttactatataacctagcaaatccattcctaggtctatccaaaatatagaccattcctaggtctatatccacacaaagacttgcatgcagatattttatgggagcattatttctaatagccataaagtagaaacaacccaaacgtccatcagctgatgaacagatatagacgaaatgtggtacatctatacactggaatatgatttggcaataaaaaggaatgaaatactgatacatgctgcaacatggatgaacctcaagaatattatgctaagtaaaagaagctagacacaaaagaccacatgttgtatgattccatttataagaaatgtccaaaaatggcaaactatggagatagtaagtagactagttgctgcctgaggctaaagttgggaacagggattaactgtaaatgggcataagagatcttactgcaatgataaaaatgttctaaaactataccacgtgatggtggcataactcagtaaccttacgaaaatcaccgaatcatacacttaaacatgggtaaatgttatatgtagattatgcctcaataaagttaataaaaaacaaataggcatctccttctctataaagtccaaggaagtaactcacatgtgtgccgatgttgaccaccaaatgtttttccacttcagggctagcaaggcaaaaccagcagggtcctggaggctgagcttcatgtaaaagaaagccaggtgttactatggtccaagcactacagcatataatcaccccacagaactcagctttgtctgatttttatatcctgaaaagactggtatacaacactgccacaatgggctgagcctgtgctcctcactacgaccccctatgaacattttcaatgaaattaaacttccattagaatttgtaaccaatccacaggtaggtaacccacaagtgcaaaatcacacactgactaaagtagcacataactggcaataggctacaacaaaagaacactgaactgggtgtcaggagccccaattaaagccccagctatgccattagccatgaccctggaaaatttaccctcccaaggtcagcttcttgtgtgaaacaaaaagatgaagaaagagaatctcaatgaaacactcttaaagtccttccttcgagtttgatcattctattattttatgaacccatattggttttggaggctcttcacctcattatgttttacagacacaaaggaaaggtgctttttccatagtacaggaagcgcctcagaacagcctcgaagtcaggccattcttattttattttttttgagacggagtctcgctctgtcgcctagggtggagtacagtggcgcgatctcggctcactgcaagctccgcctcccaggttcatgccattctcctgcctcagcctcctaagtagctgggactacgggcgtctgccaccacgcctggttaattttttctatttttagtacagacggggtttcaccgtgttagccaggatggtctcgatctcctgacctcatgatccgcccacctcggcctcccaaagtgctgggattataggcgtgagccaccgcgcctggcccgttattttatttttttgagacagggccttgctctgtcacccaggttggagtgcagtggtgcaatcttggctcactgcaatctccgcctcctgggttcaagcgattctcatgcctcagcctcctgaggagctgggactacaggtgggtgccaccatgccttgctaattttttgtatttttagtagagacagggtttcaccatgttggccaggctggtctccaactcctggccttaagtgatccacccgcttcggccacccaaagtgctgggattacagttagtgtgaatcagtttccagcattacataattctagataaaaattcataaagctctagtttctgaatctgaagctataaaaagaatatcaactttttttttttttttgagatggagtctcactctgtcacccaggctggagtgcaatggcatcatctcggctcactgcaacctctgcctcctgggttcaagcaattcttccacctcagcctcctgagtggctgggactacaggaccgtgccaccacacctggctaatttttgtatttttagtagagaaggggtttcactatgttggccagactggtctcaaaattctgaacttgtgatccgcctggctcagcctcccaaagtacaggattacaggcatgagcccccacacctggccaagaatatcaacgcttttatcccaatatgggtatataagcaacagaagactgcctttttaggacaaagaaaattgctttaaatggtaattagcaaaaggaactcatcactctcaagtagatgggctaaaaatacagagtccaagaagtatataaaagcatcacccctagagaaccatacctatttatgagacaggaaaagagggagctatcttgtaaaactggctattgctataacaaatgttgacagggatgtggaaaagcagaaaccttcatacattgccagtgggaatataagatggtgcagtcaccacacctggccaaggccatgtttatattttatttttactgttggtcctaatgactcattgcacaattctcccctgccagaagaggctctcttagcaatgctgctttccaaagaaaagccaaaataacagttactgttcatagaagaaacctctggaataaaggtacttacgaggtttgcgaggctgctttggatgaggagaagatttgctatctctacctgtggatgaacgcttccttccctgcttttcatttaaatcaaagaaaaactgacaggctgattcttcctggaatggccaaaagcagaagattaaatgttattcaactaacctttagataagtagccgaccactcacatacaagggaacattcctgccatgccatacctatctttcttctcagtcctttctgcacactctagggaagcaaaatatcttcccagttctgatgcctgaagtctcagtcatacatcaacacttatccaaactactgccaaattcatctctttggaaaaacgagttaaaatgcaagttataaagtaattcttgcctaaagcagaacatgaacccacctaaattctcttttcttttttctctcaacagggacatagtgtagtcatacaatttcacaggtcaaacaagcctaattcagccttaagagatgagaaggctgcttggaaagaaagaaaagtctgagaaagcagaccgtgcatgctagtaagggaacttgacattccttgctttagtggggaaaaaattaatttgagaaaactctgctattaagaaaatttcttcagagtgaatcttattttcctactagcaatcatcataaaatcacaaattacattgctatgaagctgctagagccttgcctaaagagctaagaacagataatcactttagacaaagactttacaaataaaactgtaaccccaaacgtctgaatccagtttggacaaagaaagacctaatgtatcaaactgttaaccccaaactacaataaaaaacactaagcttagctgaaatctactaagattttctaaacatcatcatgatttcccaaggggaaaaaaaagatttagattctaacgattaaacttgtcttatgtactaaactataactaggaaaagaacacatataaaaatgccaaccctcaatcagaacataccacaggggcaagaatttgctttcctatggatgcttcctgcccagattttctgtaagggttttcagtgacatccggaggctgttttaccagttctgctgcatccattagcttcatgggaacaatactgaacgcgtaaagatactttagagaaaaagaacataatgacattaggggaaatactatttacccaactgtaatcaacctattttactgtgaagatttcacagaaaacatgtgaaactcagtaaaattaaaagaacagcaaccagcccatccatagctcagagagtaaacagtaaatcaaatgccaattcagtggcctctgcaggggctcaccaagggttgacaaagaaatgaacaagaaatcaaagcccccaccctcacaaaccaggagttctcactcggataatggaatagtgacaactgtcactacaaggcccagagggacttgctgtataacccttgaagacaaactgcttctgtctctgagtcccttatctttgtgtactctgtccacagaattgtggcactgccatttatttttcctaatgaaaattacaaacgaacttagtgtttctctctctgatattatacaaattctgctatatatgctaataaaattttcttaggagactagcagtaaagcaataaatattcatataaatatttggaatcttgcactaatgccacagatatcgaaaactttagataagatataaatagatgtttaaacttactactgattagggaaatgcaactaagtaacaattatatatcatttatcacattggcaaaaactttaataaaactttgacgtgggctgggggtggcggctcatgcctgcaatcccagcactttgggaggctgaggcgggcgaatcacctgaggtcaggagatagagaccagcccgaccaacatggagaaatcccatctctactaaaaatacaaaagattagccaggcatggtggcacacacctatagttccagctactcaggaggctgaggcaggagaatcgcttgaacatgggaggtggaggttgcagtaagccgagatcgtgccactacactccagcctgggcaatagacagagactccatcttaaacaaacaaacaaaaactttgacttgatccagtgagaaatatggagggggaaaaaaaaaaacactgctggggtaggggtataaattggaacaaagtttttagatgaatttaacaatgcttgccaaattttataatgtgcacaccttttgacgaaagtataagttgcttatggctgaggctaacatgtccctgagaataaaacagactgaaaatactaagtgttattcagtttgaaagggcaattaaaagaaaaattacaaatctacatttgctaagaattgggcaaaaaagctgaaaataggctggggaatttatgtggaggtcagagtggaagcaggtatgaaagggtccagcagaagaaaacatggctgccaaagtgttttgagtccgttggcaagtttggcctggccttagctgttgcaggagacgtggtgaactctgccctatataatgtggatgctgagcaaagagctgtcatctttgaccgattccatggagtacagaacactgtggtacgggaagggactcactttctcattccatgggtacacaaacctattatctttgactgctgttcttgaccatgtaatgtgccagtcatcactgatagcaaagatttacagaatgtcaacatcacggtgcacatgggggcctgtcgctagccagcttcctcgcatcttgaccagcattgaagaggattatgataagcgtgtgctgctgtccatcactactgagatcctcaagtcagtggtggctcactttgatgctggagaactaatcacctaaagagagctggtctccaggcagatgagcaacgaccttacagagcaagcagccacctttgggctcatcctggatgacgtgtccttgacacatctgaccttcgggaaggagttcacagaagcagtggaagccaaacaggtggctcagcgggaagcagagagcaccagatttgtggcagaaaaggctgagcagcagaaaaaggcagccatcatctctgctgagggcgattccaaggcagcagagctgatcgccaactcactggccaccgcagggaacagcctgatagagctgcgcaagctggaagctgtggaggacatcacattccagctcttatactctgggaacatcagctccctgccagcggggcagtccatgctcctccagctgcccctgaggggccaccctgcctgcacctccgcaggccaactgggccacagccctgatgattcttaacactgtcttccttctgccccaaccctagaaatcactatgaaatttcatgattggcttaaagtgaaggaaataaaggcaaaatcacttcagatccgccccctcccccaaaaaaagcttgaaatattatgaaaaaaacaaaatatcgatttgcttatcttttgtatgcattgtctatggcatgtgatagtggaataatcttcagactctttatctgcctattttcccacttcactaactgttcttattttagctgtctcaatccacaataggttagttttggccctgggaaatcagaaatactctcagagaagtgagaaaaacaacctatttttctggtatattcttttcatcaactgcactgttttccaatacaaagatagattccaggtatcactaagatttccctcaggaaatcttagccctaaggagagcttaggtaagtcctctgggtttctttttttttgtttcccgagacagagtctcactttgtcacccaggctggagtgcagtggcccgatctcagctcactgcagtctccacctcccacattcaagcaattctcctgcctcagcttcctgagtagctgggattacaggtgccccccaccacacctggctaattttttttattttttatagagatggggtttcaccatgttggccaggctggtctcaaactcctggcctcaagtgatccgcccacctcagcctctcaaagtgctgggattacaggcgtgggccaccatgcccagctctttggggttttcttatttcagctaaatgaagttgctaaagaagtaagcaagcatctgagggcaaattcacaaatacccatagagacaaccacatagatgtggaagtaaaggaacactgttcatttgatattttgcctttattcctctgggcctattttcccaaacccttctttaaactctcctacaaaaagacccaaagagacttgacctttcattaccatacctttacaaaggagtctccgaaactgctgagaccttgcagtcagggagaagagaagatctgaatgctaaactggacaagagatacatttatcaggcagaccatgaatatcaaccttccaccaaataggtaaatctttacctttttcttttctggatttccaacatttgccagagctataaaccgggtggcatgctgtgcattttcctgtagaatgatatggtttctacaacatatttgagagacaaaaaattgcaaacaattttacttttgatttgcaatgacaaaatatgtggactctatggggccataaaaagagcagaggtcctcagttcatcatcgccagtcaaatgatttcagataagttactatctatccgtctaatagggcaacaatccctacctcacaaggctgttttaggaagagatgagattatgtcttcagaaaccatcaaaactccaacttttggctttaaaagagttgtaaaattggcaaaatgttgacaatagttcaagctaagtgatggacacatgaggtttcactttactattgcctcttcttttgtgtaataaaaagctaaaataggccaggcactttgggaggctgagacaggaggactgcttgagcccaggagtttgagaacaccctgggcaacacagtgagactctgtctctacaaaaaaaattttttaattaactgggcatggtggtgcatacctacagtcccagctactcaggaggctaaggtaggagaatcacttgagcccacgaggttgaggctgcagtgagccttgatagtacctcagcactccagcctggaagacagaatgagatcttgtctcaaaaaaaaaaaattaaaaaaaaaaaaaatgtagtcctttgtgtctggcttcattcacttaacataaagttttcacggttcaaccatgttgtagcacatgtcagtacttcattgcttttccttgccaaataacatttcatcatatatttaccacttttaatttacccattcaccaggtgatggacatttgggttgtttgcattttgagctattatgaataatgctattatgatcatctgtgtacaagtttttgtgtggacatatgttttcccttatcttgggacaggaataaaattgccgttaccatgctgctgactcttacatttaacctttcaagaactgctaaacagttttccaaagcggctgcaccattttacactctcaccagcaatgtgtgaggattccaattcctccacatccttgtcaacacttgttattatgtatttgcctttttgactactgccatcctagtgggtatgaagtggtgtatcattgtgcttttgatttacattaccataatggctaatgataagagcatctttttatatgtctattggccttttttttttttttttttttttttgagacggagtctcactctgttgcccaggctggagtgcagtggcgcgatctctgctcactgcaagctccacctcccgggttcatgccattctcctgccttagccttccaagtagctgggactacaggcgcccgccaccatgcccagctaattttttgtatttttagtagagacagggtttcaccgtgttggccaggatggtctcgatctcctgacctcatgatctgcctgcctcggcctcccaaagtgctgggattacaggcgtgagccaccacacccagccctattggccatttttatatgttctatgaaaaactgtattccgattcttaagaactgtgtaagttttgagtggcttgttcccaaaacttctgttttcgcagtatatttttagagaacaagacattcttctagaatgagtatatggagatttaacagaaaaacctgtattacctatgattctgcattaggctgtgggattatggtaaggggggtattctcttcttgctcacttaaatttttttaactagcaacacgtaaatattacttttgtaaaaaagaagggaaagaagttattttagggataatccatgccctttatcagtgaagataattctgagcttttacttaactctctcacttgtaaaacactggttttcttggcagtatattctttaagaacttgacctctatatcaggagatcgagaccatcctggctaacacggtgaaaccctgtctctactaaaaatacaaagaattagccaggtgtggtggcggtcgcctgtagtcccagctactcaggaggctgaggcaggagaatggcatgaacctgggagacggaggttgcagtgagccgagatcatgccattgcactccagcctgggcgacagagcaagactctgtctcaaaaaaaagaacttgacctctatatacctactatgctactatgtacccccaaaaattaaaaaaataaaaactccacctctgagtgcaaaagaaaaaaaataaaaaaaaatattttcttggctgggcatggtggctcacgcctgtaatcccagcactttgggaggctgaggtgggcagatcatgagatcaagagttcaagaccagcctgactgacatggtgaaaccccgtctctattaaaaatacaaaaaaacttagccggacgtggtggcacgcacctgtaatcctagctactcaggaggctgaggcaggagaatcacttgaacccaggaggcggaggttgcagtgagccgagatcatgccactgcactccagccaggtgacagagcgagactccgtctcaaaaaaaaaaaaaagacaaaaaaaaattttttaaattttccctctcatttatttttaattgataactaaaatttgtattttttattgtatacaacatgctgttttgaaatgtgtatatactgtgggatggctaaatcaagctaattaacatatacattatctcatatttatttgtggtaaaaaattttttaaagaaatggggctccctatgttgcccaggctagagtgcagtggctattcacaggcgtagtcattgcacactatagtcttgaactcctgggctcgagcgagcctcctgcctcagccttccaagtagctggaaccacagacacacaccatcatgcctggccctgaaaaggaaaaaactgatacaagttcttgattctgaaactgaaggatttccaaagtgatttcaaattagggaacaaactcagagaagatgaatgacttgagagtcacttacttcagtgtctgagtaaccaaatggaaccaagatgttatatggttaaaaacgaacaagagaagtttatacagaagatccatggcaaattcttcaaaaagccaagaagaatgaaatgctactcaccgatatggaagcctctcataataggtcttttccaaagcagcaaaatggtatcttggtttcaagcccgtggcaagactggaaaccaaagcagaaccacattttttggtatccacttctccctagtaaacaaaaacttagtcatccatacagaccaaaagttatcaagaaatgcaaataaataataagacattttgaaatgtctttgaaatttatacatgaatacagatgtggacagaaggaactgcacattgaatttcataagtatggcaatcagagaaaaaatcttaacaaataagggagctgaactactatgaatgtagaaataggaacaactgttggaagccagagattaaaaggtaactcctccatatcaatacccaaaacacaaattattaaaaccttttttggaaagtaagctctccctctggagcccacagactgggcttctagttttggtttgttttttttttttgagatggagtcttgctttgtcacccaggctgctagagtacagtggcacaatctcggctcactgcaacctctgcatcctgggttcaagaagtgattctcctgcctcagcctccctagtagctgggattacaggcacgtgccaccacacctggctaatttttgtatttttagtagagacggggtttcaccatgttggccaggctggtctcaaactcctgatctcgtgatccgcccgcctcagcctcccaaagtgcacgcgtgagccactgcgcccagcctctagtttgttacgtagtgcatctgtagttcacgggtccagacagtcatagtcaattcagaaaatcaaagcgaaaagctaggcttcagggctcctaggatccacagaatatctggtatagagtattcaaggacttcatcaccagcatataatcctttattttgcttcagtcaaggaagtggcagtttgaggaagggcataaccacacccttcttaagtaatatgaagtttgctcaaagttattcttgctcccagaacatccccagattctgttaacaaccaattaagtgatctctcacccacagcattatttatgaactctattctaagagaaggtattacttggaaataagctaacaaagtttgttttccactacgtaaagcaggaatttccttttgtcttatgcttgtttccttcaggtttctgctgaagggcagggaattagctttgaggtcagtcctagcatcttagggactggtgaactatacttttctcctccataaatatactgtatggttatttataagccttgatcaaaatcaatttttagctccccgcaaaacaaaggggcctcattttctcatccttccttacagagcatcatatgtgtctttctctcttccttcatcactttagcagcccttctctcgatcttccctagctttgctatatccttgtgctccaaccagctctatgccttgtattctacgtaaagagtaatcatgggtttgtcaaaaaggaagagagcatcctccttgataatgcctggtatcctgttggcctttttggtcatggacacatggtgctgaaactggcaaggggtggtatacaggctccacttctggatcatcactgataatcctgaatccaaccatggagatttgttcccaaatgcattcttacatttcccttcaatgaagctcacccagtgttttctgccctcacacataaccttttcaaaatcttccttaggcttacttccaccagtgtagcgtttcactccccatgatagttgtcactcctggtgtaccatccttttcaagattactcataaaatattaaaatctggccaggtatggtggctcacgcctgtaatcccagcactttgggaggccaaggcgggtggatcactagagcgcaggagttcaagaccagcctgggcaaccctgtctctactaaaaatacaaaaattaggctgggcacggtggctcatgcctgtaatcccagcattttgggaggctgaggtgggcaaattacttgaggtcaggagtttgagaccagcctggccaacatggtgaaatcccatctctactaaaaatacaaaaaaatccgcctgtaatcccagcactttgggaggccgaggcaggcagattgtctgagctcaggagttcatgactagcctgggcaacatgctgaaaccccatctctaataaaatacaaaaaattagccaggcatggcagtgtgcgcctatagtcccagctacttgggaggctgaggcaggtgaattgcttgaacccaggaggcagaggttgtggtgagcagagatggcgccactgccctccagcctgggtgacacagcaaaactccatctcaaaaaaaaaaaaaaaaaattagccaggcgtggtggcgcatgcctataatcttagctactcaggaggctgaggcaggagaatcatttgaacccgggaggaggaggttgcagtgagccaagatcgcaccactgcactccaacctgggcgacagagtgagactccatctcaaaaaaaaacaaaaaacaaaaaacaaaaaaatcagtgaagcctcaaaacattaagaggcttaggaaagggcacttgaagcagagaatataaaaaaccattcctttataattaagatttcagcagtctcatctatgaatcacactttcatgaaattaacttttgctttgatcagttgacagaacttttagaatcctgaaaattttcacagaagacttctaataaaaggtacccaagagctaaaatactcaatataaacaggaaaagaaaaaagtcccaactcaagccagtgcaatttgcttttagaaattccaactaaacaaacactactcacagaagaattcccaaagttccccacacacttgggccatggggatgtgagcaagatatcaacacccttaaactgggaggttgtacacagcatcattctcagagaagacacatccttgggactaaaactataacctggtactggctcatttaaggattctgtcccactgaggtacacaatctgcagccccgagcttccagtgaagatacctttacgacctgggttcaaagaaaaatgaacaaattttagtcagaattgcagaatgaaaagccatcaatagggggatgaatctcccatgactctcctatgtccctgccattttacatgtctgaagtgtaaactctccagcagctcccttctggctgctaggcatcaatggtgaatggctacaacagtattcctgctcagtaaatatgaacagccctacgtggaggctgctggagcccacgggccagtatgtttatgccaggtgccttacaaatattactggaaaaagttgggaagagaagattagggaaaaggctttctgcgttctagagaagattctacatggacttaaatgcagacatctggacacaggaaaaggcaatgcgaagaaaaatacagttctaaggaagctacagtctagaaaagatgcacatagtgaaaccccatccctactaaaatacaaaaaattagccaggcatggcagcgtgtgcctgtagtcccagctacttggaggcaggcagcaacttccaagtgaaggaaaacatttggaaagaacaagtgtttaggaaaaatttaagacgccactctcttctatggttattcctggcttgtggccttgtttccattccctcctgttgccttcaagaccttgctccatcaattttcacttccctttcatctactgagtctactcagctggcgctttttgttcagaaaaaaatatgctcaatcatcgccatccaaaatgaacacacatactaagaaacttcctcctcttcagttttgaatttctgaagagtcatccatgctaagtgctttacctttttttttttttttttttttttttgagatggagtctcgctctgttgccaggctggagtgcagtggcgcaatcttggctcattgcaacctccacctccgcctcccgggttcaagtgattctcctgcctcagcctcccaagtagctgggactacaggtgaccgccaccatgcccagttaatttttctatttttagtagagatggggtttcatcatgttggccaggatggtctcaacctcttgacctcgtgaactgcccacctcgacctcccaaggtgctaggattacaggtgtgagccaccacgcccagcctactttattagttccttaaccccctgcaatcagtttccctctcccatcactctcttaaaggtcaccctatatttgccaatgttctcctgaaactatgttatcttcagtagattccatgaagttgacaatatctttacctctcaaacagtcctctaagcacttttatgtctttgttcctaccccctagatgaagatataccatccccacccaccaaggtactatcatcaacctgcttcccttctgattgtatttcttccttaataatttgatcctcttctcagctctatttttcatcattatgggaccaactctccaaagcctatactcttcaacactgatactctagaaagaactctcggaccagcacagtggctaatgcctgtaatcccagaactttgggaggctgaggcagctggatcacctcaggtcaggatttcgagaccagcctgaccaacatggtgaaaccctgtctctactaaaaaatacaaaattagccgggcatggtggcacacacccgtaaccccagctactcaggaggctgaggcagaagaatcgcttgaatccgggaggcagaggttgcagtgagccaagactatgccattgcaattcagtctgggcaacaagagcgaaagtccatctcaaaaaataataataataactctcacttccaactatatgttggatgtcctaccagtatttcaagctcactatcacatgttcactaccaagttcactgcttgatcctcctactggatccaaaaaatctatttcacagaaataacccaagtaccttagctgctctttcctttcctggcactaaattcatatagtaaaatggctgccaaatatctacagtaatgcccttaatccaaatctacaaactataccaagaactgcataagtcaggctcatgttaaaatctacaacagaatttcaaaatgcgtatctgatatgtgtagttaaaactaaacagtgctcacttcagcagcacatatactaaaactggaaagataaagagaatattagcacggcacctgcacaaggatgacatgcaaattcatgaagagttccatattaaaacaacaaaacaaataaagtccttccttcaatttttgcttaaagaagtcccacaggattagtgcaaaataagactggtaacgggagggccatagccaaataaagactaaaggccaagatgaactatgatggggaaggagagagaggacatttacagcaaaggaaatgaagaagttttctagagaaataagaccaacaaggaggaaatgtgaagaatagtaaattcaactaaaaaaaaaaaaaaaagccgagcacagtggctcacacctgtaatcccagcactttgggaggctgaggcaggcgggtcaccaggtcaggagatcgagaccatcctggccaacatggtgaaatcccgtctctactaaaaatacaaaaattagctgggtatggtagtgcgtgcctgtaatcccagctactcggaaggctgaggcaggagaatcacttgaaccagggagtcggatgttgcagtaagccgagatcatgccactgcactccagcctgagcaacagagcaagacactgtcttaaaaaaaaaaaaaaaaaagagttgaatgatctaagaggcagcagactgccagcaggtggggggaaaacaaaagcaaaatttgacagtgcttttgaaaacagccagacattgaaagagccactaaaagcaatacagagggctgtggaggaaacaactttaagctggaactgaagagtgtacctagaaccagaaaaaggagagtaaaaaaagagtaaaaagcccccaaagaacagcactaaaaacctgagttgccaaaaccttagagtgaaacctagagctataaatagttgggaggctcattaacaagtaagctgtatatacctagcaagattgtatggtaaagccacatacatgaaatttcctttgtgtgaacataatttataccttaagtatcccatatactatagacaaggagtttatccctccagttggctaaacaagtgtgtaccgggttgtgggaacgcaacgatattggggctaagtggtagaaataataaagaaaaaatgccactgtcctaaaggcattgtcctaagggcacagcagcacatatacagactctgggaaaaaaccctccaaaccccattatctcaggctgcaatcactgaaaaatctagccaaaaatttcctgggagactaattcctgagaacactatattatgttcattacaaatacaacaaatatcggccaggcgcggtggctcacgcctgtaatcccagcactctgggaggccgaggtgggcggatcacgaggtaaggagatcgagatgatcctgactaacacggtgaaaccctgtctctactaaaaatataaaaaaaattagccgggtatggtcacacacgcctgtaatccaagctactcaggaggctgaggcaggagaatcacttgaacccgggaggtggaggttacagtgagccaagattgcgccactgcactccagcctgggtgacagagcaagactccgtctcaaaaacaaaaaacaaaaaacaaaaaaaaaatacaacaagtatcagcttacccagataagtaatgttttcagctaattcacatccatcagcatcctggaaatattttactgtttcctggttattagcaccaagcacatatgtctgaataggagctagtgagggaaacagacatgacaccatatagttaccagatctgctttagaacttaagatatgcctctctatagaaaaaatacttatattaaaagtaaatagtccatgcattcacattccccatatttagcaatcctaaatgtggaacagctatccactaaggatatactacacccaaccttgtagcttggctattttatttattttatttttttttttttgagacagagccttgctctgtcgcccagggtgaagtgcagtggtgcaatctcggctcactgcaatctccgcctcccaggttcaagcaattctcctgcctcagtctcccgaggagctgggattacaggcatgcgccaccatgccctgctaatttttatatttttagtagacacacggtttcaccatgttggccaggctggtcttgaacccctgacctcaggtgatccacatgcctcggcctcccaaagtgcggggattacaggtgtgagccactgcgccggatagtcttaataatgaaaagcaacttaaattcttaaatactgaaaataactcttaaattcttaaataatgaaaaacaactctgcaagaactctggcccttgaaattttattagaaatcatatgttaaataaaaataatttctatacctttcttgatgccagtcttatactcctcccattcagcatcttgggtggagccaaagaaatttcctacacacaacagcagctaaaatgagttttttaaacagatatatgagattttaaaatatcaaacagtacataattgatagtaatattcaactagttatttaatagtttcaaatcagtttttaattcttaatcaatttgcagatttcaatatacaattctttagcagcaactgttaacagttactgattctatgaattattaagttttggctctttggctgtcaaattcaagttagagatgggtaagagagagtcaaggaactaaacttttaaagtaagttagaattcaagtgctcctcaaattcccagtcccactctgccattcatggctctctccacatatccttccctggaatatacagtcacatagaaatagatctttaaagaatccccgtgtgaaacaaaaaaacttaaaatattagaatctgagaaatacaaggtataaaaaacacatttcctgcctgttgtctttacccaacctttaacccaatgaacaaattatcctcatacctggaatactctcttctgtactcttaggagtttacagtctagttggcaaccatacacaacattcatatagagcttttaagcttgtgatgggttggtatgtatgttacctgacttaatcctcatcacattcatgaaatagatctgtgcttcccaaacccagaggtcagaatcacttagggaagtgttgctagtctgttttcagttttttgtacagtgataaagtaacaatattcaaattcaaaaaatataaagatcaatagtaaacagtaaataggtctccctcccccagccactcagcagctactaagttcctatgctcatgaagggaactcaatttaacaaaaatggtatgtgttcaatcaagacttaaaggagtgcaaactttatttttatgtgtgactacaaaggtaaaattaaattcagtaaaaacaaacatcttacatcaaagtttccacttttcttctgaattgcttgaactctattgaataaaatatcaaactttccttcaacatctccacaagccaagctgcaaacaaagagataaacattatagcaattcaggaaacaaatgggcctgccgggtttggtatatactggtcttttggattagatagatacatgatctagtctctctgcagttaccttgcaaggttcagtgcacgtaaaccactgggcagatccactgagggtctcaccaacacctcccactcgccgtatctaaaatttagcttatcatttactccacaattgagccagcttcttctcctcattcctaagttttgtggacatgtctatggctgacatggtcaacaaaagtcaaaaatcccccatccagtcaccaagtcccatcaatccctttttccaaacatctttcacattcattctatccttcttattttgactcctcctatcttagtacgactcctcctatcttagtacagggcttcagtcattcatttgataaacaggtactggacacctaccatacgctaagtacaatatgccaagtatactatgctaaaaacatgttagcagtacaaggtggaggaagactcagtttaagcctcaaagagtttataatcagggaaaggaagacactctaatcattataaatttataagaaaagggctacaacagaggtatgtgtgaagtgttatggggcaggaagtagaaaatggcaagagctgacattggtaaggtaaactggccctacgttgtgaagtgacttttactatcatctcatttctgagattttctaattctgatttatgtggtttttccacggcttatatcatttccttaatgtcttttaactcatcttgaaatattaaaattttattgttttgtgagtgtctctttctggcgtgcttttattgtacacctcgccaaactttttttttttctttttctgagacagggtctcactctgtcacccaggctaaagtgcagtggcacgaccttggctcactgcaacctccactccactccaccccacctcacccccttcctatggcagaggaagaatcagacaaaaatacaatgcatctagtgttagattcaaagtagagaatacatttatgtttcctctaatgccttctcttcctcctgtccatcctacagaaagtagtcagtttaatgttctttcctcaaaacattaagaggttccccactgcctatagaaccacagctttccacaggccctgacctgtcacctttctagtactttctccaagttttcttaactgaactggcaatttgattactctctgcctctgtcattccctagggtagttccaccctacccatcctaaatccaagtttttcccatccttcaaggtttagcacatttctgaagccttcctggctggctcagaagtcattaccttctcaaaaactcagaaaaccacattacagcatttcagagaaagctttgtcataaactaatatgacttttatttatattttgagcaccacctcctctaggaagccttctagtacctatcagttaccaatttctagtgttcccataggagcctgcatttcttccatcacagcagttgtcacacggaattaccattgtctctgggagatccactgtccagtttatacatcaccaggtgcctcatctcctcatctgggcccttttccactgttctctatcccactgaataaagatagaaatctatgacccaacaaggccagctccttttcactcacaattaaaccatcacaagccttgttgattttacttccttaataaaccctgaatccctaaactattcctctgtcatcactctacctaatcccagctgttctctactttggctctgatttgttctccacattgcagacagaactgctttccaaaatgaaaatttgatcatgccaaagcgttcttaagcatttcaataacctttttaggttaaagacaagaatacagttacgtgccacataacaatgtttcggtcaacaagggaccacatatgtaatggtggtcccataagattataatggaactaaaaaattcctatcgcctagtgatgtctagccatttgtaacatcatagtgcaatatattactcatttgtttgtggtaatgctggtataaacctactgggctggtggttataaaaagtgtagcacatacagttatgtacagtatacaatatttgataatgataataaacaactatgttactggtttatgtataatatttagcatgctatggccaggtgcggtggcttacgcctgtaatcccagcactttgggaggccaaggcgagcggatcacaaggtcaggagctcgagaccatcctggttaacacagtgaaacctcatctctactaaaaatacaaaaaattagccgggcgtggtggcgggcgcctgtagtcccagctactcaggaggctgaggcgggagaatagcatgaacccacgaggcagagcttgcagtgagctgagatcgcggcactgcactccagcctgggcaacagagcaagactccatctcaaaaaaaaaaaaatatattcagtatggtatgctctttactgtttagagtacactcctacgtattcaaaaaaaaaaaaaaaaagttgactgtaaaaaagcctcaggcaggtccttcaggaagtattccagagggcactgttatcataggagatgacagcttcatgcatgttattactactgaagcccttccagtgggacaagatatggaggtgaacagcagtgatactgatgatcctgaccctgtgtaggcctagactcgtgtgtgtgtcttagtttgcaacaaaacaagtttaaagccaggcacagtggctcacgtctgtaatcccagcactttgggaggctgaggcaggagggtaacttgagcccaggagttcaagaccagcctgggtaacatagcaaaaccccctctctacaaaaaatacagaaattagccaggtgtggtagcttccgcctgtagtcccagctactcaggaggctgaagtgggagaatcacttgagcccaggaggttgaggttgcagtgagccgtgattgcacaattgcactccagcctgggcgacagtgagaccctgtctccaaaaaaaaaaaaagtttaaaaggtaaaaagaaaaaaaaagtaatagaaaaaagcttgtagaataaggatataaagaaaatatttttgtacagctgtacaatgtgttttatgtcttagctgtgttataacaagagtcaaaaagtgtaaaaaaacttaaagtttataaagtaaaagttacagtaaactaaggtttactgttgaaaataatattttaataaatttaatataggtgaagtgtacagtattcataaagtctacaatactgtaaagtaatacattcactcacctcttactaactcactcagagaaactttcagttctgcaaactccattcatgataagtgtcctacacaggttgtgccctttttttttttcctgtatacagtattttctttttttctttttctttttttttttttttgagacagtctcgctctgtcgcccaggctggagtgcagtggtgcgatctcggctcactgcaacctctgcctcccaggctcaagccattctcctgcctcaacctcttgagtagctgggattacaggcgcccgctaccacacccggctaatttttgtatgtttagtagacacagggtttcaccatgttggccaggctggtcttgaacttctgacctcaggtgatccacccacctcggcctcccaaagtgttgggattacaggcataagccaccacacccggccaggtgttttcactgtaccctttctatatttaaatacaaaaatgcttaccattgtgttacaattgcctacagtattcagtacagtaacttgacgtacagctataccatttagcctaggtgtacaggaagccataccatctaggtctctggaagtacactcaaagatgttcgcacaatgacgaaatcgcctaccaactcatttctcagaacataaccctgctgttaagcaatggattactcttatttcccaaggctcaatcctaacattctcgggaagccttcttgactcctatcattaagccaaatacccctcttatgcactctcccagattcacgaatattttcttcccaaaagttaccactattgcaatttttttttttttttttttgagacagggtttcaatctgtcacccagcctggagatcagcagcacgatcacagctcactgcagcatcgacctccccaggctcaggtggtccacctgcttcagcctcccaattagctgggaccaccacgcccggctaatttttttttttttctgtattttttgtagaaacggggccttgctatattgcccaggctggtcttgaattcctggactcaagtgattctcttgccttggcctccggagtcgctgggattataggcgtgagccactgcgcctggccctatcactatggtaactttacatttatctgaattcctttttttttagacggagtctcactctgttacctaggctggagtgcagaggtgcagtgtcggctcactgtgcaacctccgcctccgggttcaagcgattctcctgcctcagcctcccaagtagctgggattacaggcacgcgccaccacgcctggctaattttttttttttgtattagtagagacggggtgtcaccacgttggccaggctggtctcgaactcctgaccgcaagtgatccgcccgcctcagcctcccaaagtgctaggattacaggcgtgagccaccgcgcccggccattatttgtattgttttttgtttgttttgttttgttttgttttgttttgagagtctcgttctgtcgcccaggctggagtgcagtggcgcgatctcggctcacagcaacctccgcctcccgggttcaagcgattctcctgcctcagccaccgcgcccggcccattatctggattctttagtacctgttcctctagactctacgctccattaaagcaggaactccatctgttgcaacacctagcacagcgtccggcacactgcagttcttcaataaatacttgctgcatgaagccctctcttcaccaccacccccacccctcctcctcgcaaaaaaaaaaaaaaaaaaaaaatgccccagggaagggtccctatctactctgtccaccactgcccagggcccatcagtgggcccaatggctatttggcgagtaaataaatggggtcaggagaaacgaaggggaaaggatgtgtcagaggccaggactgccccctaagatggaggaggcctaactctgggagcttccgcctctccgaacgagcgtcgccaagagaaaccccctcagaagcgaaaagggccaggaaaagaggtcagccccggccaggcaaagacatcacctaagctccccagcagccccgtgtctctccgccttttccttctcccttcccgtcatgggaaagactcccgcccgtgtcgtcacctacacacacgaaagagacacagggagagaggcttccattcacggtcactcacaggcgcagcggtttctgtgccatctgtccgaatagtatgggttgcgactgccacctaaaattgggaatgcgaatccgcgctccccggaaaaatgcgaccgcgcaacaatcagacgtcagcgccctccagccaataacggttcacttacttacggagaccgccgagggacagaagcctctctcaggtgtttgcgcctcaaggaagaatcaagagggaaagggaggaacgaagggagaaagagaaagtgaccgaaaggattccaactatgattttttaaattaaatttcagagcacttgaagcgaatgaatggctaggaagtacagagcacaatgtcgggttctaacctaacctaacctaacctaacctaacctaaccatatcggtctagtgggcaagacagaccccctctatccacgttttttgtaagtttttaacctatcaaaaagttaagaggccgggcgtggacgctcacgcctataatcccagcactttggaaggctgaggcgggcggatcacttgaggtcgggcgttcaagaccagcctgggcaacatggtgaaaccccgtctcttctaaaaatacaaaaattagccgggcatggtggagaattgcttcaaccagggaggcgggggttgcagtgagtcaagatcgcgccattgcactccagcctggacaacaagagcgaaactccgtctcaaattaaaaaaaaaaaagttaaaagaataatggctattaccttgattcagtaagtctcagcatgttggcaaatttgcttgtgttctctttctctcaaagtgcccaagcccttccattctcactcaatcatttgaaagtaaagtacaggccgggcgcagtggctcacgcctgtaatcccagcactttgggagatccagaccatcctggctaacacggtgaaaccccctctctactaaaaatacaaaaaattagccgggcgtggtggcacgcacctgcagtcccagttactcgggaggctgaggcaggggaatcgcttgaacccaggaggaggaagttgcagtgagccgagatcgcgccacttcactccagcctgggcgacagagcgagactccgtgtcaaaaaataaaataaaataaagtgcggacaacaggaatacatctccatttatctcctaagattaggatatcctcctacataaccgtaatactattaacacagctaagaaaattaacattaattattcaataatattacctaatatacatccatatttaaagttctccatatttccctacaaactgattttatatttggggcttgttttgattcagatgcaatcaagtttcacacttgcatttggttctgtctctattttaatctacaaaagccctcctacctatttggttttagtttttgtaatattgacttttttgaagggttcaggccaagtggtaggaaacaagtgtgtaaggaaatggaaacaagagagagttcctgacgactgcggggaaaggaagactcatcaagggcatctaaataattcaaaattaataaaacataagattaaagaagaactacaggccaggcacagtggctcatgcctgtaatcccagcactttgggaggctgaggcgggaggttcacttgagaacaggagttcaaggccaacctgggcaacatagccagacctcgtctctactacaaatttaaaaagaaaaaaaaaaaagttagctgggcatggtggccgtatgcctgtactcccaggtactccagaggctgaggtggggagatcacttgagcccaggagatggaggcttcagcgagctattaccttgccactgcactccagcctgggtgacacagcaagccctgtctcaataaccaaacaaaactacaaagttctggcttttcccacagcctacaagccttcttttttgtttgtttcttgcctcataactggtggctctgctttgctggcacataagcatgcattttttcctactctttggataatacagcactgcccaggagtagcactcaagactgaatcttgaagaagagtagaagtttgccaaacatgagcaggtaataattcccagaagaggatacaaaagtaagacataaaaactcatcgtattgaaaaatcaaaagactccacgaaaaagactgttagaaataataaacgaattcagtaaaagtttcaggataccaaatcaacatacaaaaatcagtagcatttatatgcaccaacagtaaacaatctgaaaaagaaatcaaaaaagcaatctcatttacaacagctacaaagaatataaactacgtaggaatcaatttaactaaagaaatgaaagatctatacaaggaaaactatacaatactgatgaaagaggacacacacacaaaaaggaaagatattccacgcttatggattagaagaattaggcgggcagatcacgaggtcaggagatcgagaccttcctggctaacacggtgaaaccccgtctctcctaaaaatacaaaaaaattagccaggcgtggtagcgggcgcctgtagtcccaggtactcggaaggctgaggcagcagaatggcatgaacccgcgaggcagagcttgcagtgagcggagatccagccactgcactccagcctctagcctgggcaacagagcgagactccgtctcaaaaaaaaaaaaaagaaagaaagaaaaaagacaacactacctaaagcaatttacagattcagtccaatccccatcaaaatacaaatggcattctctagatagagcaaggatccccaacccccgggctatggaccagtacccatcagaaaccaggacgcacagcaggaggcgagcggtgggcaagtgagaataaccgcctgagctcacttcctatcagattagtggtggcatcagattcttacagaggctggaaccctattgtgaactgcacatgcgagggttctacggcgctgcgtaccttacaagaatctgatgcctgatgatctgaggtggaacagtttcatccccaaaccatccccccatccctactttcagctctctttttctaatgtaaatgtcatgtacgagcgtttgttttttttgttttgttttgttttgtttttgtttttgtttgagactgagtctcgctctgtcgcccaggctgcagtgcagtggcgcgatctacgctcactgcaagctccgcctcccgggttcacgccattctcctgcctcagcctccagagtagctgggactacaggcacccgccaccatgcctggctaattttgtttttgtatttttagtagagacgagttttcaccgtgttagccaggatggtctcgatttccttgacctcgtgatccgcccgcctcggcatcccaaagtgctgggattacagacgtgagccaccgcgcccggccacaatagttttatttgacgtcaggactgttttgtagaccgaggtgtgatagatgtggcacgcaccagccacggtttccaccgtccccagagcgtggagaggcagcgccactgctctcaaggttaatgacaactcaataaagcactgcttttattttttgcagtcttcaatttgagaaaggccagaaataatgttttcaataaatatggttcataccattaaaaaaaaaaatccccccgcgtccacggaaaaattgtcttccataaaagcggtccctggtgccaaaaagattagggactgctgctctacagaaatagaaatagaaaaaacaatcctaaaatctatatggaaccacaaaagaccccaaagagccaaagcaatcctgagcaaaaagcacaaagctgaaggcatcatactgcccaacctcaaaatctactacaaagctatggtaacccaatcagtatggtactgacataaaaatagacacatagaccaatggaacatatataaatccatgcatttacagccaactcattttatgtcaataccaaaagtacaaaggtgccaagaacattcaatgaggaaaggacagtctcttcaataaatgattcttggagaactggatagccctatactgaagaatgaaactcaactctatctctcaccatatacaaaaatcgcatcaaaatggataaagacttaaacctaacacatgaaactatgaagctaccagaagaaaatactggagaaatgttccaagatattgatctgggcaaaaattttttgtataagacttcaaaagcacaggcaacaaaagcaaaaatagactaataggattatatcaaactaaaaagctctgcacagcaaaggaaacaatcaacaaagtgaagaggcaacccacagaatggaagaaaatatttgcaaactatccatctgacaagagattaataaccagaataaatataacaaggagctcaaacaactcaatagcgaaaaaaacccacaaaaaatcctgtctaaaaatgggcaaagccatatgtggtggtgcttgcctgtagtcccagctactcaggaggctgaagcaggagggtttttttgggggagggggagggggtggggagatggagtctcactctgtcacccaggttggagtgcagtggcacagtctcagctcactgcaacttccacctctggggtccaggtgattctcctgcctcagcctcccaagtagctgggattacaggtgctcaccaccatgcctggctaattttttgtagttttagtagagatagggtttcactatgttggccaggctggccttgaactcctgacctcagatggtccacctactcagcctcccaaagtgctgggattacaggcctcagccactatgcccagtcccaggaggactgtttgagcccagtttgattccagcatgggcaacataatgagaactcatctcttaaaaaaacaaagcggggggagcaaaagatcaaaatagacatttctcaagacatacaaatggccaacagctataagaaaaaatgctcaacatcaccaatcatcagagaaatgcaaatcaaagccacaacaagatatcacctcatcccacttaaaatttcctatcaagacgacaggaattaacagatgctggcaaggatgcagagaaagaggaactcttgtacacagttggtgggaatgtaaattagtacagccactatggaaaattgtatagtttcctccaaaaactaaaaatagaactacaatatgatccagcaaattccactactgggtatgtatccaaaagaaaggaaatcaatatatcaaagagatatatgcactctcatgtttattgcagcactattcacaatagctaaaatatggaatcaacctaagtgtccatcaatggatgaatgggtaaagaaaatgtggtatatatacacaatggaatattgttcagccataaaaggaatgaaattctgtcattctcagcaacatggatgaaactggaggtgattgtgttaactgaactaagccaagcacagaaaagacaaatattacatgttctcactcacatgtgggagctaaaaaagtggatctcatggagatggaggtagattggtggttaccagaggccaggaaaggtggtggggacgtgaggatgaagagtttgattagtggacacaaatacagaagaaataagacctatgatagatcagtagagtaactatagctaatgttaatctattgtacatttcaaaataggtaaaagagaataattcaaataatgttcctagcataaagacaagataaatattaaggtgaaggacatcccaataactcttgatttaatatttacacattatatacatgtattaaattatcacttgtactctgaaaatacatacatctattacacatcaataaaaaaactcatccattaaattctgtattatctttgcaactttcccgtaaatctaaatctattttcaaaaagtttatgaaaactcatccatgggaatttaaggtggctgaagatagctgaacacagtgtaacaggaaataaaaactttttaaaaatagatcaacatggctgggtgcggtggctcacacctgtaatcccagcactttgggaggccgaggtgggtggatcatttggggtcaggagttcgagaccagcctggccaacatggtgaaaccccgtctctactaaaaatacaaaaattagcctggcatggtggtgggcacctgtaaatctcaactactcgggaggctgaggcaggagaatcgcttgaacccaggaaacagaggttgcagtgagctaagatcgcaccactgcactccagcccaggcgacagagcaagacttcatctcaaaaaaaaaaaaaaaatagatcaatacatgcacggaaaaggaaaagggttggaagaaggggtaagactgattctatgttaagatagtagagttacagtttaattcttttgttttttatttaagaaaaatgtttaaataggggccttatgttaggcacggtggttcatgcctacaatctcagcactctggcaggctgtggtaagagaatcacttgaggccagttcaagaccagcctggacaacatagtgagactccatctgtataaaaaataattagcaaggcatggtggagcgtgctggtagtcccagctattcaggaggctgaggtgggaagatcagttgagcctaggaggtcaaggtgagctattatcacaccaccacactccagcctgggtgacaatagagaccctgtctataaacaaacaaaaaaacacaagggacttgtatgcataatgaaagtctagatttttcagaggccatgataagtcactacagggttctaagcaggagtaatagggccagtttacatttttaagattgctctggcagcagtgtggagggtggttggaagggacagttaagatgagaagagaccacagcaacagtccaggaagaacagaggataaatgatgactgtctggaacagaggggaaatgacagaaacagaagtaagaaactctttgggatatgtaattggggacctcagacaccttcccagctgctaatgttgtgttctgggtaaggctgcctatctttcaacctagactggtcagtcagtatgtcccattgtctgatgtttttagtgtgcaaagaagtcgattaggtccctaagatccccccaaatcctacatacacagtaggaaggtattttataaaatcctttattttatgagtggcaatcgtcacctccctacccaacacataaacacacatacccatctagtctttgttttcatcacatttcccaaactgatcgcatgtcaatgtgactcacatagaaaataaacaagaggggcccatcacatacgccaagttatcaatactcctttcaccatttctgctcaatctagaagactcagcttggaattattttaagattttatgttatttgcaatattatggaaaagtaagttaccgacattcacaaggtgataagctgcaaagaacaagtttgttttgttttcctttttaaatttagaatcttgtttacaacacattagcatcattaacagaaaaacgaccatttacatagtaactaaaaaaccagccacttaagaaaataatgtagtaatcaaccactaccagagaaaataggtcctctcatttgattttactggtaagtccagctgttttctgaactttgtgagagtctctgtcctgaatatggcaaagcattcaagtaaaaggtaggaagttataagtgtgagattctgagggattctgtctcaaagaaggttcaggaatagccacagtcctccagtttactcgaacgttgagatgttcctgtgatgaccagcataatttccttttgaggaattttcacaattcatcagcctcaggattcaggttttataagacattcttccacattaaaaaaaaaagactctgtcccatagaaataagtttctcatcgcttctccagcttcttgtacttggcttctgtgagggatgagggagagttacatcttttaaaactggctcttacaaagacagtttttagttagcatttccagtcaagtttaaaaaatatgtataatattactaaaaatctattagcttcaatctcatcatctgtccaaatatacggatcactgatctgtaaaacttggaataagaattcaagcacagacactcagaactgagagcctaacacaggttcacgaagtcctcaccctgtcaacagcacctacttagacagctccaccaggatggggcacatctgtcacttgacctatcgggagccttactaaaaaactgcctctctcagcactgtcccaggtgccctctggaaccagactggaaccctcaggaagtataaatgtatgtttcctcctgtatgttcttatccttacaccttactccaggaaagcaattttgaaagatacagatatttaaaaggccatcaaataagcctcttactctgacattccgtttttctattaaaaccatgaaagcacctggtttcacaattttaacagaaaaagggactctgtcacaaatggttactgtgaaccaagatactttctacatggtaaggttacccctgccttctacgcggtaaggttcacggtaatcactggctaaatgtaactgtagaaaataaaactgattgttaatcgccacccatatcaaatcccagcctactacaaactactttcttgaagtagtcagcccttgttaaatgatgaaaataaaataatctgtaaatgttataaggacaaaaacaaactcaggcccgtctccctctccatctccctctcccgtctccctctctctctcccgtctccctctcccgtctccctctcccgtctccctctcccgtctccctctcccgtctccctctccctctcccgtctccctctccctctcccgtctccctctccctctcccgtctccctctccctctcccgtctccctctccctctcccgtctccctctccctctccctctcccgtctccctctccctctcctttccacggtctccctctcaagccgggccaaagctggactgtactgctgccatctcggctcgctgcagcctccctgcctgattctcctgcctcagcctgccgagtgcctgcgattgcaggcgcgcgccgccacgcctgactggttttcgtgtttttttggtggggacggggtttcgctgtgttggccggactggtctccagctcctagccgcgagtgatccgccagcctcggcctcccgaggtgccgggattgcagacggagtctcattcactcagtgctcaatggtgcccaggctggagtgcagtggcgtgatctcggctcgctatggcctccacctcccagccgcctgccttggcccccccaaagtgcggagattgcagcctctgcctggccgccaccccgtctgggaagtgaggagtgtctctgcctggctgcccatcgtctgggatgtgaggagcccctctgcctggctgcccagtctggaaagtgaggagcgtctctgcccggccgccatcccacctgggaagtgaggagcgcctcctcccggccgccatcccatctaggaagtgaggagcgtctctgcccggcagcccaccgtctgagatgtggggagcgcctgtgccccgccgccccatctgggaggtgaggagcgtctctgcccggccgccccgtctgagaagtgaggagaccctccgcctggtaaccgccccgtctgagaagtgaggagcccctccgcctggctgccaccccgtctgggaagtgaggagcgtctccgcccggcagccaccccggccgggagggaggtgggggtcagccccccgcccggccagccgccccgtccgggaggtgaggggcgcctctgcccggccgcccctactgggaagtgaggagcccctctgcccagccagccaccccgtccgggagggaggtgggggggtcagccccccgcccggccagccgtcccgtccgggagggaggtgggggggtcagccccccgcctggccagctgtcccgtccgggagggaggtgggggggtcagccccccgcccggccagccgctccgtccgggagggaggtgggagggggtcagcccccctgcccagccagccaccccgtccaggagggaggtggggggctcagcccccccgcccggc

SEQ ID NO: 1240 - DNA, 26019 bp, Homo sapiens
gccgagattgcaccatttcactccagcctgggcaacaagagcgaaactccgtataaaaaacaaaacaaaacaaaacaaaactgaaaagaaccgtggcgctagataacactattccctcttaggaggaaaaaagagcaacgagggtcatataagttaatgtgtatgattttagatatgtttttattttggttttggttgtttcaacttagcgtgacccatacaagggaaaagagggctggataaaatgtgatcatgttgaccattaataaatgcaattaatcgttaaaattcaaccatcgttataagctttgtaagcactcctcagtcagagtttttaattcagatcctggtaattcgaagaggagaatacatttctacaatctcaaggtgtaaaaaatcaataagggttgaatgaatgaggtagggtgttgtgaattagagagagagaaaaaaaaacctaattacccaccctgtgccaggcactattccaagcacttgtattaacttatttaatcctcagaacaaccctctaaaataggtgctattgttatctacattttacagaagaggaaacaagctcagggaagttgactgcctcaattcatagcctgtgaggaagatgagatttcaatctagacagtcttgattgtaactacatgagaaaaaacatagcctaacagctggtagctggttgctggtctggcaaaatagccagacaatagggttctgcttaaccaaagcaattttatagaacgccaacctcatctgtgacgatgataaaatgagccccaaacaaaacaactctgtaatcacacctgcacacaaaataaagaatgcttcacaaaccatgttattcagctgcttttggagaatgacttatttattaattatcaaatcagttacctgtgaagttaagaaataaatgtcagcaataaatcttttttaaaaagcatagatttaaattaaaattttttggctaggttgttttagtgagggcaaaaaaagtattctcaaaacaaaatctggctaagtgtggtagctcaagcctgtaatcccagaactttgggaagccaaggtgggagaaccacttgagctgggtagttcaagactagcctgggcaatatagtgagaccccatctctaccaaaaagttgaaaaatcagccaggcatggtggcacaggcttgtggtccaagctactgaggaggctgaagcaaaagggttgcttgagcccaggaggttaaggttgcagtgaagcactgcacaccagcctgggcaatacagtgagaccctgtctcaaaaaaaaaaaaaaaagaaaaaagactgcgtacaggtacttgaaaatgtctggtgtattgaaacaatagccataagtttggtgtgactaaaggctgggagggcagggtgcagcagggaaagagctgagaaggttatattgtcctgatatgaaaggctttaattgctattctaaggagggcatataggtcagttcattttacctccagcagcatggaaggcaggatttgtttttgataaatgagaactctaagactaagagtggctaactgaatatatatttttcagatgttaaataatttgggtatctaaggccaacatctctgctttcatgtgaaattccatcctttatttttaaaattataatgtatttattttatagctttattaagatataattgatgtacaacaaactacccagtgaacaatttgataagttttgacatatgtatgtacccataaaaccatcatcacaatcaaaataatgactatatccatcatccccaaacgttccttgtgcctcatcatccccagacaaacacacatctgctttctgtcaccaaagatatgtctgtgtttgctggaattgtatacaaatggaatcatacagtacctattatttgaggtcaaggttctttcacttagcataattattttgaaatgtatccatggtgttgtatgtatcaatagttcactccttttattcctgagtagtattccatcatatagacatattgcaatttgtttatccattcactagttgctggatatttgggttgtttccagttttggctgtgaacattcatgttcaagtctctttttaagagatagggtgttgctctgtcaccaagggtggagtgcagtggcatgatcatagctcactgcagccttgaactcctaaactcagcctccctagtagctgggactacaggtggtgtgccaccatgcccagctaatttaaaaaaatatatttttggctgggctcagtggctcacgcctgtaatcccagcactttgggaggccgaggcggcgggtcacgaggtcaggagatcgagatcatcctggccaacatggtgaaactccgtctctgctaaaaaatacaaaaaattagccgggcgtggtggcgcgcacctgtagtcccagctactcaggaggctgaggcaggggagtcggttgaacccaggaggtggaggttgcagtgagccaagatcgcaccactgcactccaaccttggtgacagagcaagactccgtctcaaaaaaaaaaaaaaaaaaaaaaaaaaatatatatatatatataaaagacagggtctcactatgttgtccaggctggtcttgaattcctggcctcaagtgatcctcccgccttggcctctcaaagtgttgggattacaggcttgagccaccatgtcgtgccatcaagtctctatgtggacataaatatcttggtaaatgtctaggaatagaataactggatcaatatgataggtttacgtgtaacttttaagaaactgccgatcaatcttttgcttctaccattccactgaaactgttttttatcaagatcaccaatcacatcaattttcattatttaacttaacctgcagcattggacacagttggtctctcccttctcctggaaacatacttggtaactgacctttaactggtctctctgcattttcccttaccctcttacactgtatttccatgtagtggtcagagagagccttaaatggatcaggttattcttccaacttcccttctcactcagagtaaaagctgaagttcttcagtggcatagaaggctgttatgaactgcatgattgtgtcccgccaaattcatatgttgaaaccctaacccccaatgggatggtattaggaggtaattagttcatgaaggtggagtcctcatgatgagattatcatccttgtaagaagagacacaagaaagcttacctcctttctctctgatctctgccatgtgaggatacgagaaaacatctgtttgcaaatcaagaagagtgcctcatcaaatactaagatactagatctgctggcacctagattttggacttgccagcctccagaactgtgaggaataaatgtttgttgttgaagtcatcgagtctgtggtaatttgttatagcagcccaaaaccttatatgatctgaccccacactatctcactgggctcctctcccatcactctcccctttgcttactctgcgccccttcaaccctgcaatgatcccctagctgccttaaatgtgtcaaacttcaggccttcacacttgctgtttcctctgattcaagtgccacaagccttgctctctcattgtcaagtctctgctcaaatgacaacttattagagatgtcttccctgacctcacagccctctgctcaccccacactcccttcccctgcttcattttctccaaagcccttatccgtctctgatatatcgtatacttactagtttagttgtttattgcctgtctttatgcactagaatatgagcttaatgaagactgttttgttcattgtctatcctgtacacttggagcaatgcatgcatataataggtaatcagttaatatttgttgaatgaatgaatgaatgcatggataatctctaatgacttccaattcttcaactgtgtgatttattaaagcaggaacttaaaatatcttggacaaacgcagataaaatttacctgaaaatcagtaagtgactaacgtgtgaatccttgttattacctttctcattagaaaccaatgatattgactgtgttcggaaaagccagtcatgtcttcatccttttctgattaaaatatattgttttattattattattatttgagacagggtcttgctgtgtcactcaggctggagttcagtggcacaatcatggcttactgtaacctcagcctcctgggttcaaactatcctcctgcttcagtctcccaagtggctgggactataggtgtgcaccaccatgcctggttaatttttaaatttttttgtagaaatgagggaccgggtgggtgggtctggctatgttgcctgggctggtctcaaacttctgggctcaagtgatcctcccgcctcagcctctcaaaatgttgggattacaggtgggagctgcgatgtttggcctattgtttaaaaaaactgttagattagccactagagggagctcatgcttttcttgttaacgggaaaattacatgatttgacatgcccacaaactaaacagaaatctcataaagaattatagtccttaaagctaatttaattttttattgcattttctttcttctttctttctttctttttttagacggagtctcactctgttgccacgctggaatgcagtggcacgatctcggctcactgcaacctccgactctctggttcaagcgattctcctgcctcagcctcctgaatagctaggattacaggcatgcgccaccacgcccagctaatttttctagttttagtagagacggggtttcaccatgttggccaggatggtctcgatctcctgacctcgtgatccgtccgccttggcctccccaagtgctgagattacaggcgtgagccaccgcacccggccttttattgtactttcttcctcctctctctcttttacagctttgttatgagttttccccacaagcccatgtatttctttgctcctgtgggcagcgaaaacttttggccttgcctctggacaaatctatcagggctgatagattttgtcattggtacaggccctcgcttctcatccacctccactgcctctctttttgctgatccaaggtccccaacattctccctagctggcagagatcatccctgtttccccattattcagagaaatttagcttagttttgctttaacttccataccatcaaaagtcctaggcccatctctccctaatcaaaggctccatacaaaagagacatctgccctgaggtaaattctgaggctttcagtattgcagaagtgattgctggcatttctttttctaagcaacacattttttccctctctgttatatagtttattttgacatgtatcctcttacctaatagattgtgatttttagttcttcattccagaggaaatgcaggttgtctactccaatggttaaagaaagctggtggtagatggctgtacctacttggtcctatactctaccagaaggcagaggccaagatttagttttctggagatggagataccagcaagtccttccttctttttttctttgagcaaaacaaattctttattaaaacagttgacttgaaacagtatattatatctaaaggaagagtttttttttaatctgtatagcagacttttaaagaaagcaactagttatgtataacttgacacctttccctctaatcttttgtcagtttgccccagttcataatcttattaatggacttagattagactgttcctttgtgatttattcatctccttaaaatgtagggtccaaagttgaaagttccctcctgagaactttaaaccaatgtgggtatcaaaatgcctcaagtgacttcttggcttgtgatgacttgggagctaattccactccctattaagaagtgttgcctgtttttctttctcatttaatttcatctcctgtctatataggccaaaaacgagacagtacctaaagtatctgtgattgtagtctctctttatcttcctttccaataagaaggcaactttccagtttccccgtaaggataaaacaactacagatagcttcctcccagttaactgacctagagatcgctagcatttatttatttatttatttatttaatttattttgagacagagtctcactctgttgcccaggctggagagcagtggcacgatctcagctcactgcaaactccgcctcctgggttcaaacgattcttgtgcctcagcctctcaagtagtggagattactggcgtgtgccaccacgcccagctaatttttgtattttgagtagagacagggtttcactatgttggccaggctggtctcaaactcctgaccccaagtgatccagccaccttggctgggattacaggcgtgagccatggtacctggccactagcatttaaattcataagaatagtttacagattaaatacgtctgagtcttttatccattgctctaatgtataaaatttgttcaggcacagactgctttctagtatagcaaaataattgaagattttaatcatagaacaatccttactagttaaagtcattttatgacagggcatggaggtggatatcagtgtggccaggaggattctgggatggagtcatgggaaaagtgggacttgaatcatgtgtaggtgggagtcagatgagttggaaagtaggacagggcgaataaaagaatgagcaatgcgagggcagaaatgagcatgagatgaacatgacaagagtagttgaaattgatttggaaaaggcctaaaatgaaaatttagggtgaagtatatgtcaatcaactaaaaaatacatattaggagcttcctaagtgccaggcactgctctaggcatgcagtagtggggaagacaaagtttccatggtcgagaaacctaaatttgtacatgtggtagggtaggagggaagatataagtacacacattattttaaaaggtaattgtagattgtgatggtttgatcattatatctaatcatgataaaagaaaatgaaacagactctagccaccggatttttaaaattgtgtacccttctagttaaaattagaacagccatcccatctatgtatgttttgttctcttgttagtttatattagcattattaatatgatcttccacaggaatttcttagcaggagtcttttagagccacttgcccattttgtgaaggttggcttagtgagcactctgtcttgtaatccttaaatccccttaactacatgcacataaatggaaactcatgttgcaatctgcagaaggtgaatgactgagtgagggcacatgccagcccctcagttgtggcgatgtcaccttttcctcaggaatttcttagcaggagtcttttagagccacttgcccattttgtgaaggttggcttagtgagcactctgtcttgtaatccttaaatccccttaactacatgcacataaatggaaactcatgttgcaatctgcagaaggtgaatgactgagtgagggcacatgccagcccctcagttgtggcgatgtcaccttttcctcaggaaattagcacatgacaaatgatttacagtcaattttcagttttttcttgttttttagacaaaaatgtaagttctaaatattttcatcaactccataaggtacacacactggaaccactaccactaccagagagagagtctggggaaagagtggttattttactaagggtcataagagaaggggactctgtgaagtgacatttaaactgagacttaagtgatgaggcaagaaccgccatgcaaagaagtgtgtgtaggcccaggtgtttcagggaagcagagccactatgagtattatgaggataaaaatttactataggattcagatctcacagatgaggaaggatctcagggagtgaacatctagaagggagagtcaggggatcagaggaagaatcagtgactggtccatcagaagcactgggacagttggacaaatagagcttgtgtgaaaaatccaagaagttaagcccgttcagcgccaaattggggctgctagggtctatgggagctgttgcttctgtgtaactaccgcctctgtgggtccactgccaaatatctgggtggggggcctgggaccatcactgatcatgaggccagcagtcctgagcataagctgaacatggaggaaaagagcaaggacaagctgggatccactggctaccagtgtgtctgtcaatatgtctaatcaagattaagggtcactccttcacttttgatttccaaatctcacatgagttcttctttggctaactataacctggaaccacacagggaaggagattctgggaaatgtagttgtaagactaaccaagttgatatagtacaacccagaaccacagggaacaaaaaccccagaaggcaatgaattcagtgtgctcaagagacatacagaaaaaaggtgatgctgaggctcaacaaaggaggggagggtagagggagcatgattagataagcaggcagatcccagcttatgttaggccagctcatggtatgttttgacttaatgctaagctgcaggattttaagcaaggtggcagcattctgtaagttattttttaaaaagattattctagttgtcatggaagttagggaagcaagagaaatgttgagaagaagagccaacagggaaaacagcaggctactgaggtagctcaggaaagagacaatgatggcctggactaggattataaaatacagatattgagaactggtcaggaagccttttagtctcatttctccaacatgttttttcagtgctggaaacatttctctctctatgagatgtaggatccatctgctgcaaggaagatgcagcagaggtaagtggttagggaggatctgggacaaacattgaggactttctctgcaccaagacctatgctgaacctgctcctcacaacaatctggaatgaggaaaatgatgcactgggaggttaaatattatactttaaccagggtcacacagttaataagtagtgggcccctgattctaaccaggatatctcagaatccaggatcttagctccttccagagtcctgttgcctctcaggtgaaggcccttgtgagaattcatgtctaccattagcagctgttatctgcccgaatattacacctgtctggcctctaaagtgtacatcaagtgtacaggctgatgctcttcgttccactctcaaccttcttagagactccacgctgcgtaatgcctccagcccaagtttcctggacccttaaataattcattcagtgtttaggtctccatcataactacttgaggctttacaatatttaaacatatacaattttagggatagaaaagaagacgtgttggcttcctggggacacacctcattggaatagtgttactcttgaggattaggaaatacattgaattctacataatgcttttttttttttttttttgacagagtctcactctgtcacccaggctggagtgcagtggcatgatcttgcctcactgcaacctccacctcccgagttcaagtgattctcctgcctcagcctcccaagtaactgggactataggcgcatgccaccatgcccagctaatttttgtaattttaatagagatgggctctcaccatattggccaggctggtctcaaatccctgacctcaagtgatccgcccacttcggcctcccaaagtgctgggattataggcgtgagccactgcgcccagccccacataactcttttaaatcagtgttgttgtaaggcagtgttgtcatattttccataggttttttttcctgttcccgatcgaccctttaaagagctttcatgtgttatctcaactagtgttacactttatttgagagaaagctaaaaagtaaataaggacatataagatttactattaaacattcaacagttgaagggtacattcaagagaaaaaaaatcaagatctgttttctgattaatggtctatttattgataccattctattttaacaaagaaaatatttcaaattacaaggtatacaagtcaatactgttttgaagtgaaaaattatttgctttgagagtgtatgcatgtatgtatatatatgataaatgattataacgtgtgtgtcagtgacaatatgtagtctttggttgttagttatatactgtctacctgtgagatgcaaggtaagtgggtcacagactctcaaatttatgaaacacttagatttttcagggaagttacatgaaggaactagggagtttcatgattagataagacgttcgggtgggatctccaccggacagcactctaaatcatcagcagtgtgagcagtgattcaatttgggaaagtgagtataggtttaaattctggccacagacaacctctcctacacaattcactgaacctcccctggaaggaggtttccacatcctgcagaggctaactgggcaccaatcatgcttccactaaccgacttggctgcttcctctagcgcttagtacttcaccgttccctttcttcatgggagatggtgtggtaattgataatcacaatacaaactctgaaacaagtaaacggacaataaaactcatatttgcctaaaatgagtttcgataaggatctcggtggctatcttgttagatcttagaaagctgaggcttattgagaaagcccttttccttcgggaaaaggaatttttgtatggttgggaaaaggttggtcactggctgatctataaagtccttttcattgtaagattatatgattttcggtaaactgtatattttttaaaaacagtccagaatatccgcaagtgttttaccacgtgcttcttattgttggagaagctgagcaaacatcctgtcataaaaagacaaggatgttgcatcatccctggtccctgtagtgagtgtcctgaagataataagtaagaggttaccagaggctagccaacatggagtagccaggaaagagccagcacctgctctgagacaatggtctggttgccatcctgcccataacaacatcaattaaaaaattattaaaacctagttccacagtattattaggcactgtggaagaaacagggaaatatactgtggctcttgccctcaaggagctgacaatctggttggagagataggataaacacccaagaattagttaaccattgagtgttcacccatgtggtactgaaccaagtgaaacaggagttttaagataatttgtgtgtccaaaaaggtttatttaagaggcaggacttgaactaagctggactgagtgaggatgaattgggagaagaaagcacttctgtggggtgttggggacaagatgagaaaggagttgactcagataaatcagagcatatgacaggtgcactggagagaagaaaggcactgcattgtggtaggatggagaagagctgacttgaatgaagcaaaggggaacaaaaagaaataaagtggtcagcctgagcgggcaagatggaatcacatggcttccaaagccagaaaggaggctctgaaagccacacactggtgatctccagtggtgatacccaataacaatcagcatgaatctctcagacacattgtgtgtgaggcctgtaggctgattcaaatacagaggttgatggccacagcagcttggtgaggtccagctcaatttcaaactgcttggctcaccagcatgctaacaggcttaggacttgctgacatgtgcctcagatactctctggaggctgcagtacgtggaagcctagggctgctcttccaggcagctgttgtgagtgggatgtggttgggtgaacatctgtgtagacatgggtattgctaaaatcatggccttaagcatgatgaaattcaactggtgggtggtagaagaacaaagacaatcatagcctttaacaattcttaacgtttggattcttaaaatcaactttctaactttagttacaatttcagagtaatgttttaaattttctagtcaaattaataagcctttgtattatatgccatcctcctttggaatgatagcggtataattaaaatagaacatttttaacacagaatacttattggtgaagtggtctcttatgtagtcttcttttgacgagaacgttgagattttcgaactttcagaactttctttttttgatgttttttcccattcttttgctttttcttttggctgacctgtgagaagaaggggaaaaagggcaatgtttctgaatcttaccatttttacttccttttatttggactctcctgatcattgtctcatacccacatagtctcaaaaccacattaaagtcacttcactctcagaggggctcccttagattctctctactttgctcactttgaggaggaggcaacagccttcaaactggctgtcttttgtctattcttctggcttattacattctcctggcaaccttgcttaccactcacctgccccagctacaaccctctgaaggtggcactattatcatccacgttttacataggaggaggctgagttctggagagggtgactttcccaaatctagacagctagtatgtggcagaacctccagtctgtgagactccagaacccaatctcccacccacatattctgtggctctcttcaaatccaactccttagtatgccatgcaggattcctcccgctttgtcctgatctacttttctgcctcagtcccttcactctcttcacacaaactccagccacattaatggaggctccctgaacacagcaggttctctcatgattctactcttctgctcatgctgtccttaccttcctggcaaattatttatccttcaagacccaaatcaaatatcacctgacatgagaaatcttccttaacactttctcctgccccattcccccagcaaagttaagtactccctcctctatgtcgtcaagattcttgtgcatacttttatatttctcacattgtaccataattattagcatatgcactacaacaggaagggactataccttattatctttgtatcctgtgtctaccattcaattcattacatatttattgtattaaataaggacaagctctgtacccccaaggaacacacattcttccagtgggagacagagaggggatactatatgtaggaacctaattttgtcctaggaacaaaatagaagcaccataatatgaatgaaaaatgtattcttaaaagttatgtattcttatagtgttaatgaaaaagcagattctttgtcttctaaagttaatttctaaaagaaagaaaattttgatcttccttttcaccaacctgtttctcccactttttaatcagttccttcacatctgctgaatctgggtttagacatgtttgaactccattcttcagtgtagcactgccaaagaaatagcaatgagatagttttttctcattaataatttaaatgcttcttctcagaaataatgaaaatcagtatgaattgtgctgaattttctaatgaaactacttaaaattatttcctaggacaagatgagtcactggttgaatttttttttttttctttttttgagacagaatttcgctctgttgccaggctggagtacagtggtgcgatctcagcttgctgcaacttccaactcctggattcaagcgattctcctgcctcagcctcccgaatagctgggactacaggcatgcgccaccacgcccagctaatttttgtatttttagtagagacagggttttaccacattggccaggatggtctcaatctcttgacctcatgatctgcccacctcagcctcccaaagtgctgggattacaggtgtgagccactgcacccggccctggttaaattttaaaaattacttacagtagactgtctggaaataatttaaatgttcctttaatttttctgtatagtctgagaataagagtagtcaaggatgacttataaagacaaaatatgcacacatccttcaacctagcaatcctaatctctagaaaggaaagaattacagacacaatactgccacagtaagttttatttcagcagtaaaaatttggaaataatctatatttccaacaataatcctggtcatataaattatggtttatccatatgatgaaatacagtttggccattaaaaatgacattaagtaaaaatgacattattagagatttactgacacgagaaaatgttcatgatatagtgttaatgaaaaagcagattacaaaacagtgtatagtatatgatttaatttttgtgcttatatacgtgtatgtaaaaacatatctatgttatgtgcacacgaagcaagtaaggaagatttagaaaactgtatactaaggggttaacagtatttgtcactcaagggtagaattatgcgtgatttttattttcttctattgtgttacctgcattaaacattttgtacaataaacatgtgtcattcttggggcctaatctaccagaaattccttgcatttttaaggagaagaaaagaaaggagctgcccaaatttatggagggggtaaccatctgatttttaagtgtttgtatgggcaagcactccaagggtaaaactcatgctaaatttaatgttcttgccaatatggtgcatgcatgttagctgggttgttacttacatgatttcaattttctcgcaggaagggcttggggcaaattgtttaaggtctttcaaggattgtaggtggatagtcccttggttggtgctgatgcaggaacagcgaccctttctcactactggggttcctgagggaaagaaaaagatagaacacatcagtataggccaatgtttcagtttaggtgatctatcaaaatgatacacttgactgagtcatgattattgctatcatttaccgagtgcctaaaaataatcaccacaaacctttgaaggaggtatcatctctattttatacataaggaaactaaggttcagaaagattaagaacaaagtcatacagcttttagggagcaggggcagggttttagcccagatctctctgagtccaaaggcgttgctcttaactaccacaccgtaagtccgtgggagaaaaagagactttcacaatatttaataaatgcctatcacaagacaaacagataactaattcatgtatgctatgctgatcacagtttcttaagcaactcctaaaccatctattatttattatctgaccttaaggaatggaactggtgttggtgttgaatagaaagcactcctttgtaaccaatcaccactttcatcctcatcctctctcctccccactgccttgcttttcaatagtgttttaaatttttgaaaaccccttaaaatacattatcttaattcttaaattcatatatttacttggtacttattgtaccatatgccatacattgtgtagcagtcagaaaaggtataactacaaagttctattttacagatgatgaggaaactgaggtctagaaagattaagtaatttgtccaaggtaacaaagatagttagtaaatagattagggacaaattctctgattattggttggatccttaattggttagccacagatatacttagcaaaaaacagtatcagggagaagaaaataatttaggagatagagttctcattattacccagttcaatgaacatttattgaacacttactaggaattcatacacctagactacaaagacttgtgtttgacttggcagatcgaagttatgaactttggataactggtcatgtcactgagaagcttttatgactgaccaaatattactcttcaatgcaggcagaacattcacctttatctggctaatcaagattcttttacagtgaatcacttctcttactttacaacctaactcagaaccccttaccttgcactccaatcagaaccagcaagatgatgcccaagaggaaaagaacaccacttttcttcatagtgatagaatggagttccaagtcactcctgtattggattttgagcctgagaaattctttagagaacacattttggggatcatatttatttaggatattcatttctctcctaaactctgattggctagtatctttagctgagctaactaaattgaccacaaacttgattgtgctgggggaaaccctagtctcagatccaagggaatttctgcatgtttttatttccatttcacataaatgggtggtttatagtaagggatgtgaaactagcaacactgatagcctttggcacattcacagttgctcacctgtgtgaagaataggttatataatgaatatactaatgttatacaacaaaggttggagatgtggtttccagatgggaaatattaaagtccagataaataatatacttttcaaattcccttactatttatggcatattcttctgtataatagatggctacattgatattttcttatattgcccacttaacaacttaaagcaccttaatttcctctgggaccaggtcattttctactagtggtaagctcattctgtatcattcctgctacagtattattttttaaactaataaattggttagaataaggggtcagttgcatgtaagagacccaaattaacagtggctaagaaatgcaataaaaatgaagataaatagctgggacctaattaaagagcttttgcacagcaaaaggaacagtcagcagagtaaacagacaacccacagagtgggagaaaatcttcacaatctatatacctgacaaaggactaatatccagaatctagaatgaattcaaacaaatcattaagtaaaaaacaaacaatcccattaaaaagtgggctaaggacatcaatatacaattctcaaaagaagatacacgaatagccaacaaacatatgaaaaaatgctcatcactaatgatcagggaaatgcaaatcaaaaccacggtgtgataccaccttacacctgcaagaatggccataatcaaaaaatcaaaaaacagcagatgttggtgtggacttggtgatcagggaacacttctacactgctggtgggaatgtaaactagcacagccgctatggaaaacagtgtggagattccttaaagaactaaaaagcagaattaccattttatccagcaatcccactactgggtatctacccagaggaaaagaagtcattatttgaaaaatgtacttgcacatgcatgtttatagcagcacaattcacaattgcaaaatcatggaaccaacccaaatgcccatcaatcaatgagtgaataaagaaactgtggtttatatatacacaatcgaatactactcagtcacaaaaaggaatgaattaacggcattagcagtgacctggatgagattggagactattattctaagtgaagtaactcaggaatggaaaaccaatcatcatctgttctcactggtatgtgggagctaagctatgaggacacaaaggcataagaatgatacaatggagtttggggacttgtggagaagagtgggagcggggtgagggataaaagactacaaatagggtgcagtgtatactgcttgggtgatgggtgaaccgaaatctcacaaatcaccactaaagaacttattcgtgtaaccaaataccacctgtaccccaataacttatggaaaaataaaaaaaaaaaaaacaacaacagaaaacagtggctaagatagaagcttatttctccctgagagatgtaggtggattagcacttggatagtggctctttcccatgaggtcttccaggcttctcctttcttgtgttgtcaccatctctagattgctgccctcatgcacatggccaaaggtggcttgccaccatgtccaatttccaggtataggatgatgagaaggcagaaaaagggcatgtccctcctttttagacatcctagaagttgcacccatcattttctatcacctcccatggaggcaggccttaatcacatggctacacctagttgtaggggaagttaagaaacgtcatctttattttggttgactagctaaagattggagatttccttattgtaaaacaatgtttctcaacgttttttttcattatggactcagcactgcatgcgtgtgtgcgcgcatgtgcacccacacacacacacacacccccccacatttcaccttgctctgagaaaaaataaaatgaactgaaaactaaatttaatttcttcctgaagagagaaatcaaatgctaagaaataagattttgttgggtagggttgaaccttggtaggccactagtcattgcaatatctaaaattttttagctctccaagaaccaatattttcccccttgggagcaatttacctctcttcccattgacaatgcatgctgtagaattggaggaaaatggatattagcatttcatgtcacatggtgcacattttttgactgacttctatacagattattaatacttaaatggaattacagaattctttttgaataaaacatgtggtgaccattgatacagcttatccatttgctcatgcttaattttggtactgactgtggcaatgcatagagtgcaaataggttcacgttcctgctttaccacttaatgactgtgtgcaaaatacttaatttttgtgagcttcatctccctcatttaagaaaattattagacctcacagggtgttaaaattaatgccaaggacggattgtcaactgcaaagcctcacagggctagtggctgttctttccagcaaagaaaggaggatggaaatttcttaggataagaactaaggcccagcactgttggtgctacccacctttctagcctcttcttacacagctctctgctcccatcactttgtcttctctcagttttcttttcttttctccttctccttcccctcccctcttcttttcttttcttttctttctttttgagaccgttttttttttttgcccaggctagagtgcaatggtgcaatctcagctcacggcaactttcgtctcccaggctcaagcgattctcctgcctcagcctcccaagtagctgggattacaggcatccaccaccatgccaggctaatttctgtatttttagtagagaccgggtttcaccacgttgcccaggccggtctcgaactcctgacctcaagtgatctgcccgccctcccaaagtgctgcaattgcaggcgtgagccactgcacccggcccttctctcagttttcaaaggggacaatgctccttcccatggcactgtttttgctcatgccattcttctgcctggagcgactgtgcatgctcctcattcctgccctcctgcatagtagttactcaccatagttacccaggccagcatcatttccctgggaagactttcctgaaccccagaggggctctcaccgcacacttgcagaggccttgctgagcccgtgtccgcagcaacgctacgtttccctgcaaccctatggttaacatttccttccaccactaggcaaggaaggcctgcgacgctccccgtctgagcatggtgctaaacacagtgcctagcacccagtaagcgcacacgcatgagggaaggagctgggagctggctcggcaggtctggaagttggatagggtctgtaaagggctgcctggctccaggggcctcacacgcagcgacctcagccgggcccaaggtgcgtgtactgcgcatgcccagccaactggtcttccagaaccttcttcagtgaggaggttatacccggaggtctcgacgctcgctcgtgctgctcgtgttgccgctgggtacgtttgctgccagtgctgatccagccggaggcgaagagaagcactttgggggcaaaaggtaggggttgtgccttcaggatctctcctctctgtcccctgagcggcccgcagcctccccagccgagatggccgtgcttttggggatgggtgggaaggttctcagcggcggtggccatgagcgaagaggcccgttttgcaggtttcacacgaggcttgggtgaggccagcagggaacgacggccccagaagggccagggcactgggcttaggggtaaccctgggccgtgggcttcagtgactgggaaagaggcccttcggataagagaaaggaggtgttggggtcagttgggagtcactgaggccagatcttatttgttacccaaaaaggggctaattttctgagatagcaagcggaatgggagggcttctctcgcctgaccctacttcgtggtgaaactgttctgccatggtagggtagggccccgcccctctgagcaggctggggccgctgcgcccagctcaggcctgtccagacactagtttcctgggcttcgtttaggaacttgtcatgcaaagtctgagagcaaccacattctctcaggaagcaggcagcgggaaggagaaaatcccattgatcgttgcatttatggctagacaaggcttttaggagaaacagaaacctgatgagaggatgttgcaggcgtttctcacagccctgggaatggagccaaagatgatctagagttgaaatcaacagttaccaattcctttttggacaagaattttaacttcctgtgccttgaaaaattccagttctgtgtccgtaggggatccaaatgctaatgtaaccccaaagaactttacaaagcggaattcttagttttcacaagtgtggcccagcctccctcttgaatctttttggttgtggaatcgaggtgttctgtttaattatccagtgtgactgactctgtggcagggacggtaagagccttccctttttacttgtgagaggagaagtttctctcataaagaaacctccaggcctgtttgaatttctcacagtgtggatttcccctcctctcggcagctgttgttagtattaaactgactagaaaggggtttatttcttgaaagtcttagaagccccaagagaatattctgatttttctttttccctctcctctccccacgcagggagtcattccttccttcctaaatacaacatggtgagttacatgcaggcaaatcctagctgtgggaggttttatatcctgtctgcatctaagtcactaagagaaaggaccaagttcttcctttgctaatcttattatctggcttcttggtttatatttctcatgtaaaacttaaggactgggttaggtttgtgaataaacagttttgagagagcatgttaaggacatgatgtaaaggacaacttttgcaaaatgttgacaatagcaacatttttgcttggtgactttaggcaagtcagcttgtagtctgaggatatgtaacaatagccattaagaagctgctgactaacctggagaaaaattatcctgaaaagaaaacatgtttatacttaaaatatccatacttatttaaaatgtcactttaaaattgcatatgtaagtaattttacaagaaaaaatccacattcttaaaaatcttcatttactgtttatcattcatttcatccaccaaacttttattcttatggttctagactctgaggtcacatatgtgaacaatgatttcctcagagagttcacagttcagtgggggaaaacagcatgtacattaacacttattatagaagaagtggtatgataaaggattgtacagaataattggaggtacagagaagtgcacaaccctggctgatgggttcagacgcagctgtctgagttaggtctgaaaaggagaattggctggaatttgttacaagaagaagttgggggaatattctaagcaagaggcaggagaaggtatgccaaatttgagaacctgcaagtactttagcaagggtggacggtagagtgaataatggagtggtgagaaattggtctagaaatgtggcaggaacaagacgatgaagtgccttgtgaatctctatgtggggaggagacactgcagaattttaactaagggaataacatgagatttatatatacacacacacacacacccctgtgtatacatctgccccttgtcaccagtctttaatcttattttacttgaacatttccttgtgtctacgtagtttatatatttgtaaaatgttctcatatttctagcctcttcattctcagttctgtgtatttgagttgtttccaataatgtctcagtaatacaacagtgatcttactattttaaaaaagattttactctcttggggtatttcccatctttgaaactgtagggacaaaggttaaaaaacgtttctgtatcttctgtaacattttgacagattgcttgccagaaagattgggctatcagtatgtagatgtatctgtttcacaatcctcttgtcattttatttacttttgttcatttagcatgtgaaaattggcactagagactagtgttaattccattttctttacaaattgatattttactttgtattggtttaacatctgcatttcctacctttttaagaccacttgtcaagtagagtcagagttttgaccttgtaaatatctatcaattctttacatattttgattaggaagctctaatgcatttttagtgaaaatatttgctttttccattttgttaaattaatttccttcataattaaaaaaaagaaaacacaacttaggggctgaattgtgttcccccaccgaatgcttatgttgaaaacctaactgccagtacctcagaaggtgactgtatttagagatagggttttcacagaggtaattaagttaaggtgaggtccctgaggaagcacagtctttggacttactagaccaagatattaaatcagctgtcttaaatatactcaaagaactaaaggaaatcatgtacaaaaaaacaaaaggaaacaagacaaaatgagaatattaataaaggggtagaaattataaaaaaggaaacaaatagaaatgatggagcggaaaagtgcaaaactgaagtgaaaaaatttagtagatgggttcaacagcagttttgagccagcagaagaaagaatctgcaaatctgaagataggacaattgaaattttcaaggctgagaagtagaaagaaaaaagaatgaagaaaagtgaacaaagcctaagagacctatgagacaccatcaagtggaccaatatatgcttaatatgagtttcggaaggagaagagagagaaagggacagaagactattcacagaagtaatgactgaaaactaacgaaatccaatgaaacgtatgaatctgcgtgactccaagaagctcagtgaactccaagcaagttaaactcaaaaagatccacactgagatacctaatagtcaaactgctaaaactcaagagacagagaatcttgaaagcaacaagtgaagtgattcatcatatacatccaagggatcctagataatattaacagctgatttcttatcagaagccaaggaagcaagagggcagtgaaacaacatgtttaaagtgctgaaagaaaaaaaatctgtcaatgaagaattctatatctggcaaaactacccttcaagaatgaaaaagaaatgaagacatttttaaatagactgaagctagggggagtttattactagtagacttgctctacacaacatattgaaggcagtcctgcaggctgaaatgaaaggatactaactccaagccatataaaggaataatactggtaaaggtaactatgtaggtaatataaaaaccagtattattgcacttttggtttgtaccttctcatttttcctatgtgaattaaaaaatgcataaaaccataattataaatatgtattaatgagcacacagtgctgtaatctgtgacaataacaattgtcaaaggggagggatgcagatgtataggagcagagtgtgtttgtttactgttgaaactaaggtggtattcaaactaggatgttacaagtttaggatgttaattataatccccaaagtaaccagtaagagaataactaaaaatatacagaaaagaaaagaggggactcaaaatagtacactctaaaaattcaactacttaccaaaaaaggaagtaatggagaaattgaggaacaaaaaaataagacacttaaaaaattcaatagctgaaaggcaaagtaaaaccttccttatcagtaataactttaaatgtaaatgaattaagctctggcctaatgagcttatatgtataaaggtttgatttgctttggtttgttgagacagggcctcactctgttgcctaggcttgagtgcagtggcatgattatggttcactacagcctcaacctggctcaaacaatcctcccacctcagcctctcgagtagctgggaccataggcatgcgccaccatgcccagctaatttttgtattttttgtagagatgggtttttgccatgttggtcagtctagtctggaactcctgggctcaagcgatcctctggccttggcctcctagagtgctgggactataggcacaagcctggcctgggattataggcacaatgcctggcctaggtttgttagtattttattgaggatttttgcatcaatattcatgagagatattggcctgttgttttcttttttgatgtgtctttgattttggtatcagggtaatactggccttatagaatgagtttggaaagtctttatttctccttcatgtttaaaggatattttcactggatatgctattctaggttaaacatgttttttcttcagcactttaaatatgttatgccattctatcctggcctgtaaggtttccactgaaaagtttgctgctagacatatttccagatatttgaagatatttgagtgttgctatctaagccatatttgcgttaggaataccccaagcccagtaatactgtagtttttgcagactcaaagagataccgccttggtcttagataagatttggaagaattctctggattaccaggccgactcttgttctcttcccttagtttctcctaaacaaatgaagtctctctctctgtgctgagctgcttggggttgggggtggggtgacaccaagcacacctgtggccaccaccactgacgttgtgctgagtcagacctgaagccagcacagcactgggtctcacccaaggcatgtcactgtaaccactacctggctaccatctgtgtttgctcaaggccctacagctctaccatcagcatgtggaaaagtcagccaggcttatatccttccctgcaagcagcaagttttcccaggcaccagatgggcccagagatgctgtctgggagccagggactggagtcaaaaaccttagatatctccctggtgctctattctgttgcggctaagctggcactcaatctatgagacaaagtctttcccattcctccctcccctttccagaggcagaggagccttttactcatgcccatcaccacagacccatgggatgtacagacaggctacctaacaccaatattcacttaaggcccaagggctcttcagtctgcttatggtgaatgctgcccagcctgggactcacgtttcagggcagtgggctcccctctgggccagggcaggtccagaaatgccatctaagcccaggctggaattgggggcccaagagcccacttggtgctctacctcactgtggccgagctggtacctgtggttcaagaaaaagtctcctttacttttccttctgcttttctcaagcagaaggaatctctcactatgaccaccacagttgggaatgtgctgggtctcacctaaagccagcatatctgagtctcacccaaggcccactgtgtactacctgggtattggctgctggttattcagtgcccaagggctcttcagtcagcaggtgatgaatcctaccagcagtgggtccttcccttcaaggcagcaggttcccttctggcccagggcatgtctagaaatgtcatccaagatctagggcctggaataggggcctcatgactctctgcccagcactctatcctactgtggctgaactcgtatccaagtttcaagacaaagtcctctttattcttccctctcctcaa
